US012551569B2

(12) United States Patent
Lazzara et al.

(10) Patent No.: US 12,551,569 B2
(45) Date of Patent: Feb. 17, 2026

(54) RNAi AGENTS FOR INHIBITING EXPRESSION OF MICROTUBULE ASSOCIATED PROTEIN TAU (MAPT), COMPOSITIONS THEREOF, AND METHODS OF USE

(71) Applicant: Arrowhead Pharmaceuticals, Inc., Pasadena, CA (US)

(72) Inventors: Phillip Lazzara, Madison, WI (US); Ji Young Suk, San Diego, CA (US); Christine Esau, San Diego, CA (US); Tao Pei, Middleton, WI (US); Xiaokai Li, San Diego, CA (US); Agnieszka Glebocka, Madison, WI (US); Zhao Xu, San Diego, CA (US); Jeffrey Carlson, Madison, WI (US); Jingdong Ye, Lincolnshire, IL (US); Kayalvizhi Madhivanan, San Diego, CA (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 0 days.

(21) Appl. No.: 19/094,954

(22) Filed: Mar. 30, 2025

(65) Prior Publication Data
US 2025/0302980 A1 Oct. 2, 2025

Related U.S. Application Data

(60) Provisional application No. 63/695,099, filed on Sep. 16, 2024, provisional application No. 63/573,135, filed on Apr. 2, 2024, provisional application No. 63/572,350, filed on Mar. 31, 2024, provisional application No. 63/572,349, filed on Mar. 31, 2024.

(51) Int. Cl.
A61K 47/68 (2017.01)
A61P 25/28 (2006.01)
C07K 16/28 (2006.01)
C12N 15/113 (2010.01)

(52) U.S. Cl.
CPC ...... A61K 47/6807 (2017.08); A61K 47/6849 (2017.08); A61P 25/28 (2018.01); C07K 16/2881 (2013.01); C12N 15/113 (2013.01); C12N 2310/11 (2013.01); C12N 2310/312 (2013.01); C12N 2310/313 (2013.01); C12N 2310/315 (2013.01); C12N 2310/321 (2013.01); C12N 2310/322 (2013.01)

(58) Field of Classification Search
CPC . A61K 47/6807; A61K 47/6849; A61P 25/28; C07K 16/2881; C12N 15/113; C12N 2310/11; C12N 2310/312; C12N 2310/313; C12N 2310/315; C12N 2310/321; C12N 2310/322
See application file for complete search history.

(56) References Cited

U.S. PATENT DOCUMENTS

| | | | |
|---|---|---|---|
| 4,522,811 A | 6/1985 | Eppstein et al. | |
| 5,998,203 A | 12/1999 | Matulic-Adamic et al. | |
| 2008/0113351 A1 | 5/2008 | Naito et al. | |
| 2021/0363523 A1 | 11/2021 | Khvorova et al. | |
| 2022/0091138 A1 | 3/2022 | Kim | |
| 2022/0411796 A1 | 12/2022 | Polydoro Ofengeim et al. | |
| 2023/0203486 A1* | 6/2023 | Soundarapandian ........ C12N 15/113 514/44 A |

FOREIGN PATENT DOCUMENTS

| | | |
|---|---|---|
| WO | 20000053722 A1 | 9/2000 |
| WO | 2001053340 A2 | 7/2001 |
| WO | 2004045543 A2 | 6/2004 |
| WO | 2008022309 A2 | 2/2008 |
| WO | 2011104169 A1 | 9/2011 |
| WO | 2012083185 A2 | 6/2012 |
| WO | 2013032829 A1 | 3/2013 |
| WO | 2013148260 A1 | 10/2013 |
| WO | 2013148283 A1 | 10/2013 |

(Continued)

OTHER PUBLICATIONS

Hammond SM, et al. (Nov. 8, 2022) JCI Insight. 7(24):pp. 1-18; e154142. (https://doi.org/10.1172/jci.insight.154142.).*

(Continued)

Primary Examiner — Robert S Landsman
(74) Attorney, Agent, or Firm — Paul VanderVelde; Meibo Chen; Mitchell Porter

(57) ABSTRACT

Described are RNAi agents, compositions that include RNAi agents, and methods for inhibition of a microtubule associated protein tau (MAPT) gene. The MAPT RNAi agents and RNAi agent conjugates disclosed herein inhibit the expression of a MAPT gene. The MAPT RNAi agents are conjugated to an antigen binding protein that may enable subcutaneous delivery of the RNAi agents by facilitating crossing of the blood brain barrier (BBB). Pharmaceutical compositions that include one or more MAPT RNAi agents, optionally with one or more additional therapeutics, are also described. Delivery of the described MAPT RNAi agents to central nervous system (CNS) tissue, in vivo, provides for inhibition of MAPT gene expression and a reduction in MAPT activity, which can provide a therapeutic benefit to subjects, including human subjects, for the treatment of various diseases including Alzheimer's disease, Frontotemporal lobar degeneration dementia (FTLD), Progressive supranuclear palsy, and other tauopathies.

26 Claims, 3 Drawing Sheets
Specification includes a Sequence Listing.

(56) References Cited

FOREIGN PATENT DOCUMENTS

| | | | |
|---|---|---|---|
| WO | 2013158141 | A1 | 10/2013 |
| WO | 2014153236 | A1 | 9/2014 |
| WO | 2015010135 | A2 | 1/2015 |
| WO | 2015068075 | A2 | 5/2015 |
| WO | 2016019063 | A1 | 2/2016 |
| WO | 2017109679 | A1 | 6/2017 |
| WO | 2017214112 | A1 | 12/2017 |
| WO | 2019161213 | A1 | 8/2019 |
| WO | 2019175260 | A2 | 9/2019 |
| WO | 2020191153 | A2 | 9/2020 |
| WO | 2020191171 | A2 | 9/2020 |
| WO | 2021188626 | A1 | 9/2021 |
| WO | 2021202511 | A2 | 10/2021 |
| WO | 2023278305 | A1 | 1/2023 |
| WO | 2023049871 | A2 | 3/2023 |
| WO | 2023064707 | A1 | 4/2023 |
| WO | 2023114700 | A1 | 6/2023 |
| WO | 2023154900 | A2 | 8/2023 |
| WO | 2023175091 | A2 | 9/2023 |
| WO | 2023220349 | A2 | 11/2023 |
| WO | 2023245061 | A2 | 12/2023 |

OTHER PUBLICATIONS

Paul, WE (1993) Fundamental Immunology, 3rd ed. Raven Press, NY, Chap. 9, pp. 292-295.*

Rudikoff, S et al. (1982) Proc. Natl. Acad. Sci. USA, 79:1979-1983 (doi: 10.1073/pnas.79.6.1979).*

Colman, PM (1994) Research in Immunology, Elsevier, NY, 145(1):33-36.*

Bendig M. M. (1995) Methods: A Companion to Methods in Enzymology, 8:83-93.*

Maccallum et al. (Oct. 11, 1996) J. Mol. Biol., 262(5):732-745. (doi: 10.1006/jmbi.1996.0548).*

Casset et al (2003) Biochemical and Biophysical Research Communications, 307:198-205. (doi:10.1016/S0006-291X(03)01131-8).*

Chen et al. (1995) EMBO J., 14(12):2784-2794. (doi: 10.1002/j.1460-2075.1995.tb07278.x).*

Xiao B, et al. (Mar. 2025) Molecular Therapy:Nucleic Acids. vol. 26. pp. 1-15.*

Watts GF, et al. (Dec. 12-14, 2024) "A Phase 3 Study to Assess the Efficacy and Safety of Plozasiran in Adults with Genetically or Clinically-Defined FCS at High Risk of Acute Pancreatitis". Poster #0023. World Congress Insulin Resistance Diabetes & Cardiovascular Disease (WCIRDC); Universal City, California.*

Raal F, et al. (May 4-7, 2025) "Zodasiran (ARO-ANG3), an Investigational RNAi Therapeutic, Demonstrates Profound and Durable Reductions in LDL-Cholesterol and Other Atherogenic Lipoproteins in Patients with HoFH; Gateway Final Results". European Atherosclerosis Society (EAS); 93rd Congress. Glasgow , UK.*

Altenhofer EF, Lawler MJ, Kumar P, Joyce LA, Fowler-Watters M, Pei T, Li Z. Synthesis of a novel cyclopropyl phosphonate nucleotide as a phosphate mimic. Chem Commun (Camb). Jul. 14, 2021;57(55):6808-6811. doi: 10.1039/d1cc02328d. Epub Jun. 18, 2021. PMID: 34142689.

Czauderna F, Fechtner M, Dames S, Aygün H, Klippel A, Pronk GJ, Giese K, Kaufmann J. Structural variations and stabilising modifications of synthetic siRNAs in mammalian cells. Nucleic Acids Res. Jun. 1, 2003;31(11):2705-16. doi: 10.1093/nar/gkg393. PMID: 12771196; PMCID: PMC156727.

GenBank NM_001123066.4; "*Homo sapiens* microtubule associated protein tau (MAPT), transcript variant 6, mRNA"; 2025.

GenBank NM_016834.5; "*Homo sapiens* microtubule associated protein tau (MAPT), transcript variant 3, mRNA"; 2025.

Mummery CJ, Börjesson-Hanson A, Blackburn DJ, Vijverberg EGB, De Deyn PP, Ducharme S, Jonsson M, Schneider A, Rinne JO, Ludolph AC, Bodenschatz R, Kordasiewicz H, Swayze EE, Fitzsimmons B, Mignon L, Moore KM, Yun C, Baumann T, Li D, Norris DA, Crean R, Graham DL, Huang E, Ratti E, Bennett CF, Junge C, Lane RM. Tau-targeting antisense oligonucleotide MAPTRx in mild Alzheimer's disease: a phase 1b, randomized, placebo-controlled trial. Nat Med. Jun. 2023;29(6):1437-1447. doi: 10.1038/s41591-023-02326-3. Epub Apr. 24, 2023. Erratum in: Nat Med. 2024.

International Search Report and the Written Opinion for corresponding International Application No. PCT/US2025/022218; Date of Mailing—Jul. 14, 2025.

* cited by examiner

RNAi AGENTS FOR INHIBITING EXPRESSION OF MICROTUBULE ASSOCIATED PROTEIN TAU (MAPT), COMPOSITIONS THEREOF, AND METHODS OF USE

CROSS REFERENCE TO RELATED APPLICATIONS

This application claims the benefit of priority to U.S. Provisional Patent Application Ser. No. 63/572,350, filed on Mar. 31, 2024, U.S. Provisional Patent Application Ser. No. 63/573,135, filed on Apr. 2, 2024, U.S. Provisional Patent Application Ser. No. 63/695,099, filed on Sep. 16, 2024, and U.S. Provisional Patent Application Ser. No. 63/572,349, filed on Mar. 31, 2024, the contents of each of which are incorporated herein by reference in their entirety.

FIELD OF THE INVENTION

The present disclosure relates to RNA interference (RNAi) agents, e.g., double stranded RNAi agents such as chemically modified small interfering RNAs (siRNAs), for inhibition of microtubule associated protein tau ("MAPT") gene expression, compositions that include MAPT RNAi agents, and methods of use thereof.

SEQUENCE LISTING

This application contains a Sequence Listing (in compliance with Standard ST26), which has been submitted in xml format and is hereby incorporated by reference in its entirety. The xml sequence listing file is named 30743-US1_SeqListing.xml, created Mar. 28, 2025, and is 2660 kb in size.

BACKGROUND

Neurodegenerative diseases, including Alzheimer's disease (AD), frontotemporal dementia (FTD), and other tauopathies, are characterized by the pathological accumulation of microtubule-associated protein tau (MAPT or tau) aggregates. Tau is essential for the stabilization of microtubules within neurons; however, under pathological conditions, it undergoes hyperphosphorylation, leading to its aggregation into neurofibrillary tangles (NFTs). These tau aggregates disrupt cellular function, ultimately resulting in neurotoxicity and neuronal death. The presence of tau pathology strongly correlates with cognitive decline and disease progression, making it a critical therapeutic target for neurodegenerative disorders.

Currently, there are limited therapeutic options for directly targeting pathological tau, and existing treatments for Alzheimer's disease and related tauopathies primarily focus on symptomatic relief rather than disease modification. Various approaches, including small molecules, monoclonal antibodies, antisense oligonucleotides, and gene therapy, have been explored to mitigate tau aggregation, promote tau clearance, or modulate tau phosphorylation. However, challenges such as blood-brain barrier penetration, off-target effects, and limited efficacy have hindered the successful development of tau-targeting therapies.

Given the urgent need for effective disease-modifying treatments, there remains a significant demand for novel therapeutics that can directly and specifically modulate tau pathology. The present disclosure relates to RNA interference (RNAi) agents, e.g., double stranded RNAi agents such as chemically modified small interfering RNAs (siRNAs), for inhibition of microtubule associated protein tau ("MAPT") gene expression, compositions that include MAPT RNAi agents, and methods of use thereof.

SUMMARY

There exists a need for novel RNA interference (RNAi) agents (termed RNAi agents, RNAi triggers, or triggers), e.g., double stranded RNAi agents such as siRNAs, that are able to selectively and efficiently inhibit the expression of a MAPT gene, including for use as a therapeutic or medicament. Further, there exists a need for compositions of novel MAPT-specific RNAi agents for the treatment of diseases or disorders associated mutant MAPT gene expression and/or disorders that can be mediated at least in part by a reduction in MAPT gene expression.

The nucleotide sequences and chemical modifications of the MAPT RNAi agents disclosed herein, as well as their combination with certain specific antigen binding proteins and/or lipid PK/PD modulators suitable for selectively and efficiently delivering the MAPT RNAi agents to relevant CNS cells in vivo, differ from those previously disclosed or known in the art. The MAPT RNAi agents disclosed herein provide for highly potent and efficient inhibition of the expression of a MAPT gene.

In general, the present disclosure features MAPT gene-specific RNAi agents, compositions that include MAPT RNAi agents, and methods for inhibiting expression of a MAPT gene in vitro and/or in vivo using the MAPT RNAi agents and compositions that include MAPT RNAi agents described herein. The MAPT RNAi agents described herein are able to selectively and efficiently decrease expression of a MAPT gene, and thereby reduce the expression of the MAPT protein.

The described MAPT RNAi agents can be used in methods for therapeutic treatment (including preventative or prophylactic treatment) of symptoms and diseases including, but not limited to, various central nervous system diseases and neurodegenerative diseases (including Alzheimer's disease, Frontotemporal lobar degeneration dementia (FTLD), Progressive supranuclear palsy, and other tauopathies).

In one aspect, the disclosure features RNAi agents for inhibiting expression of a MAPT gene, wherein the RNAi agent includes a sense strand (also referred to as a passenger strand) and an antisense strand (also referred to as a guide strand). The sense strand and the antisense strand can be partially, substantially, or fully complementary to each other. The length of the RNAi agent sense strands described herein each can be 15 to 49 nucleotides in length. The length of the RNAi agent antisense strands described herein each can be 18 to 49 nucleotides in length. In some embodiments, the sense and antisense strands are independently 18 to 26 nucleotides in length. The sense and antisense strands can be either the same length or different lengths. In some embodiments, the sense and antisense strands are independently 21 to 26 nucleotides in length. In some embodiments, the sense and antisense strands are independently 21 to 24 nucleotides in length. In some embodiments, both the sense strand and the antisense strand are 21 nucleotides in length. In some embodiments, the antisense strands are independently 18, 19, 20, 21, 22, 23, 24, 25, 26, 27, 28, 29, or 30 nucleotides in length. In some embodiments, the sense strands are independently 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. The RNAi agents described herein, upon delivery to a cell expressing MAPT such as endothelial cells, neurons, microglia, and astrocytes, inhibit the expression of one or more MAPT gene variants in vivo and/or in vitro.

The MAPT RNAi agents disclosed herein target a human MAPT gene (see, e.g., SEQ ID NO:1). In some embodiments, the MAPT RNAi agents disclosed herein target a portion of a MAPT gene having the sequence of any of the sequences disclosed in Table 1.

In another aspect, the disclosure features compositions, including pharmaceutical compositions, that include one or more of the disclosed MAPT RNAi agents that are able to selectively and efficiently decrease expression of a MAPT gene. The compositions that include one or more MAPT RNAi agents described herein can be administered to a subject, such as a human or animal subject, for the treatment (including prophylactic treatment or inhibition) of symptoms and diseases associated with MAPT protein levels.

Examples of MAPT RNAi agent sense strands and antisense strands that can be used in a MAPT RNAi agent are provided in Tables 3, 4, 5, and 6. Examples of MAPT RNAi agent duplexes are provided in Tables 7, 8, and 9. Examples of 19-nucleotide core stretch sequences that may consist of or may be included in the sense strands and antisense strands of certain MAPT RNAi agents disclosed herein, are provided in Table 2.

In another aspect, the disclosure features methods for delivering MAPT RNAi agents to neurons, astrocytes, microglia and endothelial cells in a subject, such as a mammal, in vivo. Also described herein are compositions for use in such methods. In some embodiments, disclosed herein are methods for delivering MAPT RNAi agents to central nervous system cells (neurons, astrocytes, microglia and endothelial cells) to a subject in vivo. In some embodiments, the subject is a human subject.

The methods disclosed herein include the administration of one or more MAPT RNAi agents to a subject, e.g., a human or animal subject, by any suitable means known in the art. The pharmaceutical compositions disclosed herein that include one or more MAPT RNAi agents can be administered in a number of ways depending upon whether local or systemic treatment is desired. Administration can be, but is not limited to, for example, intravenous, intraarterial, subcutaneous, intraperitoneal, subdermal (e.g., via an implanted device), and intraparenchymal administration. In some embodiments, the pharmaceutical compositions described herein are administered by intrathecal injection or intracerebroventricular injection. In some embodiments, the pharmaceutical compositions described herein are administered by subcutaneous injection.

In some embodiments, it is desired that the MAPT RNAi agents described herein inhibit the expression of a MAPT gene in central nervous system cells.

The one or more MAPT RNAi agents can be delivered to target cells or tissues using any oligonucleotide delivery technology known in the art. In some embodiments, a MAPT RNAi agent is delivered to cells or tissues by covalently linking the RNAi agent to a targeting group or an antigen binding protein.

The one or more MAPT RNAi agents can be delivered to target cells or tissues using any oligonucleotide delivery technology known in the art. In some embodiments, a MAPT RNAi agent is delivered to cells or tissues by covalently linking the RNAi agent to a targeting group or a lipid moiety.

An antigen binding protein can be linked to the 3' or 5' end of a sense strand or an antisense strand of a MAPT RNAi agent. In some embodiments, an antigen binding protein is linked to the 3' or 5' end of the sense strand. In some embodiments, an antigen binding protein is linked to the 5' end of the sense strand. In some embodiments, an antigen binding protein is linked internally to a nucleotide on the sense strand and/or the antisense strand of the RNAi agent. In some embodiments, an antigen binding protein is linked to the RNAi agent via a linker.

A PK/PD modulator can be linked to the 3' or 5' end of a sense strand or an antisense strand of a MAPT RNAi agent. In some embodiments, a PK/PD modulator is linked to the 3' or 5' end of the sense strand. In some embodiments, a PK/PD modulator is linked to the 5' end of the sense strand. In some embodiments, a PK/PD modulator is linked internally to a nucleotide on the sense strand and/or the antisense strand of the RNAi agent. In some embodiments, a PK/PD modulator is linked to the RNAi agent via a linker.

In another aspect, the disclosure features compositions that include one or more MAPT RNAi agents that have the duplex structures disclosed in Tables 7, 8, and 9.

The use of MAPT RNAi agents provides methods for therapeutic (including prophylactic) treatment of diseases or disorders for which a reduction in MAPT protein levels can provide a therapeutic benefit. The MAPT RNAi agents disclosed herein can be used to treat various neurodegenerative diseases, including Alzheimer's disease, Frontotemporal lobar degeneration dementia (FTLD), Progressive supranuclear palsy, and other tauopathies. Such methods of treatment include administration of a MAPT RNAi agent to a human being or animal having elevated or MAPT protein or MAPT activity beyond desirable levels.

BRIEF DESCRIPTION OF THE DRAWINGS

These and other features, aspects, and advantages of the present disclosure may be better understood when the following detailed description is read with reference to the accompanying drawings.

DETAILED DESCRIPTION

Definitions

Figure 1:
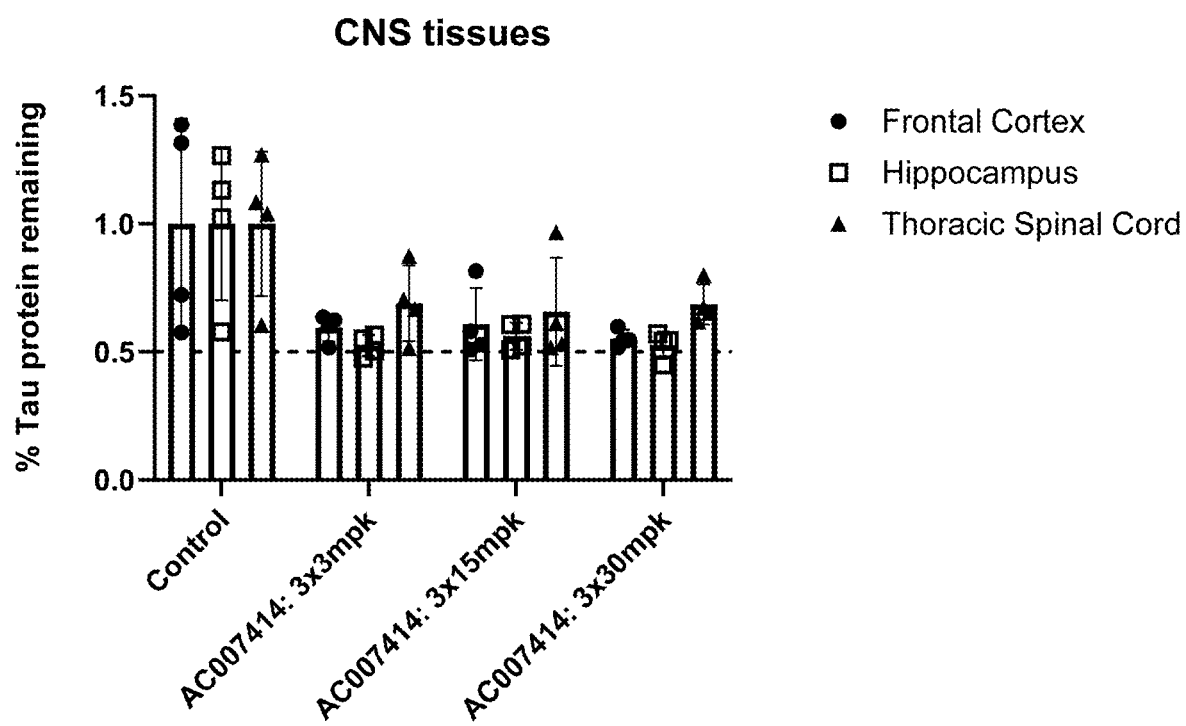
FIG. 1 Depicts the knockdown of MAPT protein in hippocampus, frontal cortex, and thoracic spinal cord in cynomolgus monkeys administered MAPT RNAi agents according to the study described in Example 2.

As used herein, the terms "oligonucleotide" and "polynucleotide" mean a polymer of linked nucleosides each of which can be independently modified or unmodified.

As used herein, an "RNAi agent" (also referred to as an "RNAi trigger") means a chemical composition of matter that contains an RNA or RNA-like (e.g., chemically modified RNA) oligonucleotide molecule that is capable of degrading or inhibiting (e.g., degrades or inhibits under appropriate conditions) translation of messenger RNA (mRNA) transcripts of a target mRNA in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. RNAi agents disclosed herein are comprised of a sense strand and an antisense strand, and include, but are not limited to: small (or short) interfering RNAs (siRNAs), double stranded RNAs (dsRNA), micro RNAs (miRNAs), short hairpin RNAs (shRNA), and dicer substrates. The antisense strand of the RNAi agents described herein is at least partially complementary to the mRNA being targeted (i.e. MAPT mRNA). RNAi agents can include one or more modified nucleotides and/or one or more non-phosphodiester linkages.

As used herein, the terms "silence," "reduce," "inhibit," "down-regulate," or "knockdown" when referring to expression of a given gene, mean that the expression of the gene, as measured by the level of RNA transcribed from the gene or the level of polypeptide, protein, or protein subunit translated from the mRNA in a cell, group of cells, tissue, organ, or subject in which the gene is transcribed, is reduced when the cell, group of cells, tissue, organ, or subject is treated with the RNAi agents described herein as compared to a second cell, group of cells, tissue, organ, or subject that has not or have not been so treated.

As used herein, the terms "sequence" and "nucleotide sequence" mean a succession or order of nucleobases or nucleotides, described with a succession of letters using standard nomenclature.

As used herein, a "base," "nucleotide base," or "nucleobase," is a heterocyclic pyrimidine or purine compound that is a component of a nucleotide, and includes the primary purine bases adenine and guanine, and the primary pyrimidine bases cytosine, thymine, and uracil. A nucleobase may further be modified to include, without limitation, universal bases, hydrophobic bases, promiscuous bases, size-expanded bases, and fluorinated bases. (See, e.g., Modified Nucleosides in Biochemistry, Biotechnology and Medicine, Herdewijn, P. ed. Wiley-VCH, 2008). The synthesis of such modified nucleobases (including phosphoramidite compounds that include modified nucleobases) is known in the art.

As used herein, and unless otherwise indicated, the term "complementary," when used to describe a first nucleobase or nucleotide sequence (e.g., RNAi agent sense strand or targeted mRNA) in relation to a second nucleobase or nucleotide sequence (e.g., RNAi agent antisense strand or a single-stranded antisense oligonucleotide), means the ability of an oligonucleotide or polynucleotide including the first nucleotide sequence to hybridize (form base pair hydrogen bonds under mammalian physiological conditions (or otherwise suitable in vivo or in vitro conditions)) and form a duplex or double helical structure under certain standard conditions with an oligonucleotide that includes the second nucleotide sequence. The person of ordinary skill in the art would be able to select the set of conditions most appropriate for a hybridization test. Complementary sequences include Watson-Crick base pairs or non-Watson-Crick base pairs and include natural or modified nucleotides or nucleotide mimics, at least to the extent that the above hybridization requirements are fulfilled. Sequence identity or complementarity is independent of modification. For example, a and Af, as defined herein, are complementary to U (or T) and identical to A for the purposes of determining identity or complementarity.

As used herein, "perfectly complementary" or "fully complementary" means that in a hybridized pair of nucleobase or nucleotide sequence molecules, all (100%) of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "partially complementary" means that in a hybridized pair of nucleobase or nucleotide sequence molecules, at least 70%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "substantially complementary" means that in a hybridized pair of nucleobase or nucleotide sequence molecules, at least 85%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, the terms "complementary," "fully complementary," "partially complementary," and "substantially complementary" are used with respect to the nucleobase or nucleotide matching between the sense strand and the antisense strand of an RNAi agent, or between the antisense strand of an RNAi agent and a sequence of a MAPT mRNA.

As used herein, the term "substantially identical" or "substantial identity," as applied to a nucleic acid sequence means the nucleotide sequence (or a portion of a nucleotide sequence) has at least about 85% sequence identity or more, e.g., at least 90%, at least 95%, or at least 99% identity, compared to a reference sequence. Percentage of sequence identity is determined by comparing two optimally aligned sequences over a comparison window. The percentage is calculated by determining the number of positions at which the same type of nucleic acid base occurs in both sequences to yield the number of matched positions, dividing the number of matched positions by the total number of positions in the window of comparison and multiplying the result by 100 to yield the percentage of sequence identity. The inventions disclosed herein encompass nucleotide sequences substantially identical to those disclosed herein.

As used herein, the terms "treat," "treatment," and the like, mean the methods or steps taken to provide relief from or alleviation of the number, severity, and/or frequency of one or more symptoms of a disease in a subject. As used herein, "treat" and "treatment" may include the prevention, management, prophylactic treatment, and/or inhibition or reduction of the number, severity, and/or frequency of one or more symptoms of a disease in a subject.

As used herein, the phrase "introducing into a cell," when referring to an RNAi agent, means functionally delivering the RNAi agent into a cell. The phrase "functional delivery," means delivering the RNAi agent to the cell in a manner that enables the RNAi agent to have the expected biological activity, e.g., sequence-specific inhibition of gene expression.

Unless stated otherwise, use of the symbol

as used herein means that any group or groups may be linked thereto that is in accordance with the scope of the inventions described herein.

As used herein, the term "isomers" refers to compounds that have identical molecular formulae, but that differ in the nature or the sequence of bonding of their atoms or in the arrangement of their atoms in space. Isomers that differ in the arrangement of their atoms in space are termed "stereoisomers." Stereoisomers that are not mirror images of one another are termed "diastereoisomers," and stereoisomers that are non-superimposable mirror images are termed "enantiomers," or sometimes optical isomers. A carbon atom bonded to four non-identical substituents is termed a "chiral center."

As used herein, unless specifically identified in a structure as having a particular conformation, for each structure in which asymmetric centers are present and thus give rise to enantiomers, diastereomers, or other stereoisomeric configurations, each structure disclosed herein is intended to represent all such possible isomers, including their optically pure and racemic forms. For example, the structures disclosed herein are intended to cover mixtures of diastereomers as well as single stereoisomers.

As used in a claim herein, the phrase "consisting of" excludes any element, step, or ingredient not specified in the claim. When used in a claim herein, the phrase "consisting essentially of" limits the scope of a claim to the specified materials or steps and those that do not materially affect the basic and novel characteristic(s) of the claimed invention.

The person of ordinary skill in the art would readily understand and appreciate that the compounds and compositions disclosed herein may have certain atoms (e.g., N, O, or S atoms) in a protonated or deprotonated state, depending upon the environment in which the compound or composition is placed. Accordingly, as used herein, the structures disclosed herein envisage that certain functional groups, such as, for example, OH, SH, or NH, may be protonated or deprotonated. The disclosure herein is intended to cover the disclosed compounds and compositions regardless of their state of protonation based on the environment (such as pH), as would be readily understood by the person of ordinary skill in the art. Correspondingly, compounds described herein with labile protons or basic atoms should also be understood to represent salt forms of the corresponding compound. Compounds described herein may be in a free acid, free base, or salt form. Pharmaceutically acceptable salts of the compounds described herein should be understood to be within the scope of the invention.

As used herein, the term "linked" or "conjugated" when referring to the connection between two compounds or molecules means that two compounds or molecules are joined by a covalent bond. Unless stated, the terms "linked" and "conjugated" as used herein may refer to the connection between a first compound and a second compound either with or without any intervening atoms or groups of atoms.

As used herein, the term "including" is used to herein mean, and is used interchangeably with, the phrase "including but not limited to." The term "or" is used herein to mean, and is used interchangeably with, the term "and/or," unless the context clearly indicates otherwise.

Unless otherwise defined, all technical and scientific terms used herein have the same meaning as commonly understood by one of ordinary skill in the art. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other objects, features, aspects, and advantages of the invention will be apparent from the following detailed description, accompanying figures, and from the claims.

RNAi Agents

Described herein are RNAi agents for inhibiting expression of the MAPT (or MAPT) gene (referred to herein as MAPT RNAi agents or MAPT RNAi triggers). Each MAPT RNAi agent disclosed herein comprises a sense strand and an antisense strand. The sense strand can be 15 to 49 nucleotides in length. The antisense strand can be 18 to 30 nucleotides in length. The sense and antisense strands can be either the same length or they can be different lengths. In some embodiments, the sense and antisense strands are each independently 18 to 27 nucleotides in length. In some embodiments, both the sense and antisense strands are each 21-26 nucleotides in length. In some embodiments, the sense and antisense strands are each 21-24 nucleotides in length. In some embodiments, the sense and antisense strands are each independently 19-21 nucleotides in length. In some embodiments, the sense strand is about 19 nucleotides in length while the antisense strand is about 21 nucleotides in length. In some embodiments, the sense strand is about 21 nucleotides in length while the antisense strand is about 23 nucleotides in length. In some embodiments, a sense strand is 23 nucleotides in length and an antisense strand is 21 nucleotides in length. In some embodiments, both the sense and antisense strands are each 21 nucleotides in length. In some embodiments, the RNAi agent sense strands are each independently 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. In some embodiments, the RNAi agent antisense strands are each independently 18, 19, 20, 21, 22, 23, 24, 25, 26, 27, 28, 29, or 30 nucleotides in length. In some embodiments, a double-stranded RNAi agent has a duplex length of about 16, 17, 18, 19, 20, 21, 22, 23 or 24 nucleotides.

Examples of nucleotide sequences used in forming MAPT RNAi agents are provided in Tables 2, 3, 4, 5, 6, and 10. Examples of RNAi agent duplexes, that include the sense strand and antisense strand sequences in Tables 2, 3, 4, 5, 6, are shown in Tables 7A, 7B, 8, 9A, and 10.

In some embodiments, the region of perfect, substantial, or partial complementarity between the sense strand and the antisense strand is 16-26 (e.g., 16, 17, 18, 19, 20, 21, 22, 23, 24, 25, or 26) nucleotides in length and occurs at or near the 5' end of the antisense strand (e.g., this region may be separated from the 5' end of the antisense strand by 0, 1, 2, 3, or 4 nucleotides that are not perfectly, substantially, or partially complementary).

A sense strand of the MAPT RNAi agents described herein includes at least 15 consecutive nucleotides that have at least 85% identity to a core stretch sequence (also referred to herein as a "core stretch" or "core sequence") of the same number of nucleotides in a MAPT mRNA. In some embodiments, a sense strand core stretch sequence is 100% (perfectly) complementary or at least about 85% (substantially) complementary to a core stretch sequence in the antisense strand, and thus the sense strand core stretch sequence is typically perfectly identical or at least about 85% identical to a nucleotide sequence of the same length (sometimes referred to, e.g., as a target sequence) present in the MAPT mRNA target. In some embodiments, this sense strand core stretch is 15, 16, 17, 18, 19, 20, 21, 22, or 23 nucleotides in length. In some embodiments, this sense strand core stretch is 17 nucleotides in length. In some embodiments, this sense strand core stretch is 19 nucleotides in length.

An antisense strand of a MAPT RNAi agent described herein includes at least 16 consecutive nucleotides that have at least 85% complementarity to a core stretch of the same number of nucleotides in a MAPT mRNA and to a core stretch of the same number of nucleotides in the corresponding sense strand. In some embodiments, an antisense strand core stretch is 100% (perfectly) complementary or at least about 85% (substantially) complementary to a nucleotide sequence (e.g., target sequence) of the same length present in the MAPT mRNA target. In some embodiments, this antisense strand core stretch is 16, 17, 18, 19, 20, 21, 22, or 23 nucleotides in length. In some embodiments, this antisense strand core stretch is 19 nucleotides in length. In some embodiments, this antisense strand core stretch is 17 nucleotides in length. A sense strand core stretch sequence can be the same length as a corresponding antisense core sequence or it can be a different length.

The MAPT RNAi agent sense and antisense strands anneal to form a duplex. A sense strand and an antisense strand of a MAPT RNAi agent can be partially, substantially, or fully complementary to each other. Within the complementary duplex region, the sense strand core stretch sequence is at least 85% complementary or 100% complementary to the antisense core stretch sequence. In some embodiments, the sense strand core stretch sequence contains a sequence of at least 16, at least 17, at least 18, at least 19, at least 20, at least 21, at least 22, or at least 23 nucleotides that is at least 85% or 100% complementary to a corresponding 16, 17, 18, 19, 20, 21, 22, or 23 nucleotide sequence of the antisense strand core stretch sequence (i.e. the sense and antisense core stretch sequences of a MAPT RNAi agent have a region of at least 16, at least 17, at least 18, at least 19, at least 20, at least 21, at least 22, or at least 23 nucleotides that is at least 85% base paired or 100% base paired.)

In some embodiments, the antisense strand of a MAPT RNAi agent disclosed herein differs by 0, 1, 2, or 3 nucleotides from any of the antisense strand sequences in Table 2 or Table 3. In some embodiments, the sense strand of a MAPT RNAi agent disclosed herein differs by 0, 1, 2, or 3 nucleotides from any of the sense strand sequences in Table 2, Table 4, Table 5, Table 6, or Table 9.

In some embodiments, the sense strand and/or the antisense strand can optionally and independently contain an additional 1, 2, 3, 4, 5, or 6 nucleotides (extension) at the 3' end, the 5' end, or both the 3' and 5' ends of the core stretch sequences. The antisense strand additional nucleotides, if present, may or may not be complementary to the corresponding sequence in the MAPT mRNA. The sense strand additional nucleotides, if present, may or may not be identical to the corresponding sequence in the MAPT mRNA. The antisense strand additional nucleotides, if present, may or may not be complementary to the corresponding sense strand's additional nucleotides, if present.

As used herein, an extension comprises 1, 2, 3, 4, 5, or 6 nucleotides at the 5' and/or 3' end of the sense strand core stretch sequence and/or antisense strand core stretch sequence. The extension nucleotides on a sense strand may or may not be complementary to nucleotides, either core stretch sequence nucleotides or extension nucleotides, in the corresponding antisense strand. Conversely, the extension nucleotides on an antisense strand may or may not be complementary to nucleotides, either core stretch nucleotides or extension nucleotides, in the corresponding sense strand. In some embodiments, both the sense strand and the antisense strand of an RNAi agent contain 3' and 5' extensions. In some embodiments, one or more of the 3' extension nucleotides of one strand base pairs with one or more 5' extension nucleotides of the other strand. In other embodiments, one or more of 3' extension nucleotides of one strand do not base pair with one or more 5' extension nucleotides of the other strand. In some embodiments, a MAPT RNAi agent has an antisense strand having a 3' extension and a sense strand having a 5' extension. In some embodiments, the extension nucleotide(s) are unpaired and form an overhang. As used herein, an "overhang" refers to a stretch of one or more unpaired nucleotides located at a terminal end of either the sense strand or the antisense strand that does not form part of the hybridized or duplexed portion of an RNAi agent disclosed herein.

In some embodiments, a MAPT RNAi agent comprises an antisense strand having a 3' extension of 1, 2, 3, 4, 5, or 6 nucleotides in length. In other embodiments, a MAPT RNAi agent comprises an antisense strand having a 3' extension of 1, 2, or 3 nucleotides in length. In some embodiments, one or more of the antisense strand extension nucleotides comprise nucleotides that are complementary to the corresponding MAPT mRNA sequence. In some embodiments, one or more of the antisense strand extension nucleotides comprise nucleotides that are not complementary to the corresponding MAPT mRNA sequence.

In some embodiments, a MAPT RNAi agent comprises a sense strand having a 3' extension of 1, 2, 3, 4, or 5 nucleotides in length. In some embodiments, one or more of the sense strand extension nucleotides comprises adenosine, uracil, or thymidine nucleotides, AT dinucleotide, or nucleotides that correspond to or are the identical to nucleotides in the MAPT mRNA sequence. In some embodiments, the 3' sense strand extension includes or consists of one of the following sequences, but is not limited to: T, UT, TT, UU, UUT, TTT, or TTTT (each listed 5' to 3').

A sense strand can have a 3' extension and/or a 5' extension. In some embodiments, a MAPT RNAi agent comprises a sense strand having a 5' extension of 1, 2, 3, 4, 5, or 6 nucleotides in length. In some embodiments, one or more of the sense strand extension nucleotides comprise nucleotides that correspond to or are identical to nucleotides in the MAPT mRNA sequence.

Examples of sequences used in forming MAPT RNAi agents are provided in Tables 2, 3, 4, 5, 6, and 9. In some embodiments, a MAPT RNAi agent antisense strand includes a sequence of any of the sequences in Tables 2, 3, or 10. In certain embodiments, a MAPT RNAi agent antisense strand comprises or consists of any one of the modified sequences in Table 3. In some embodiments, a MAPT RNAi agent antisense strand includes the sequence of nucleotides (from 5' end→3' end) 1-17, 2-15, 2-17, 1-18, 2-18, 1-19, 2-19, 1-20, 2-20, 1-21, or 2-21, of any of the sequences in Tables 2 or 3. In some embodiments, a MAPT RNAi agent sense strand includes the sequence of any of the sequences in Tables 2, 4, 5, or 6. In some embodiments, a MAPT RNAi agent sense strand includes the sequence of nucleotides (from 5' end→3' end) 1-18, 1-19, 1-20, 1-21, 2-19, 2-20, 2-21, 3-20, 3-21, or 4-21 of any of the sequences in Tables 2, 4, 5, or 6. In certain embodiments, a MAPT RNAi agent sense strand comprises or consists of a modified sequence of any one of the modified sequences in Table 4, 5, 6, or 9.

In some embodiments, the sense and antisense strands of the RNAi agents described herein contain the same number of nucleotides. In some embodiments, the sense and antisense strands of the RNAi agents described herein contain different numbers of nucleotides. In some embodiments, the sense strand 5' end and the antisense strand 3' end of an RNAi agent form a blunt end. In some embodiments, the sense strand 3' end and the antisense strand 5' end of an RNAi agent form a blunt end. In some embodiments, both ends of an RNAi agent form blunt ends. In some embodiments, neither end of an RNAi agent is blunt-ended. As used herein a "blunt end" refers to an end of a double stranded RNAi agent in which the terminal nucleotides of the two annealed strands are complementary (form a complementary base-pair).

In some embodiments, the sense strand 5' end and the antisense strand 3' end of an RNAi agent form a frayed end. In some embodiments, the sense strand 3' end and the antisense strand 5' end of an RNAi agent form a frayed end. In some embodiments, both ends of an RNAi agent form a frayed end. In some embodiments, neither end of an RNAi agent is a frayed end. As used herein a frayed end refers to an end of a double stranded RNAi agent in which the terminal nucleotides of the two annealed strands form a pair (i.e., do not form an overhang) but are not complementary (i.e., form a non-complementary pair). In some embodiments, one or more unpaired nucleotides at the end of one strand of a double stranded RNAi agent form an overhang. The unpaired nucleotides may be on the sense strand or the antisense strand, creating either 3' or 5' overhangs. In some embodiments, the RNAi agent contains: a blunt end and a frayed end, a blunt end and 5' overhang end, a blunt end and a 3' overhang end, a frayed end and a 5' overhang end, a frayed end and a 3' overhang end, two 5' overhang ends, two 3' overhang ends, a 5' overhang end and a 3' overhang end, two frayed ends, or two blunt ends. Typically, when present, overhangs are located at the 3' terminal ends of the sense strand, the antisense strand, or both the sense strand and the antisense strand.

The MAPT RNAi agents disclosed herein may also be comprised of one or more modified nucleotides. In some embodiments, substantially all of the nucleotides of the sense strand and substantially all of the nucleotides of the antisense strand of the MAPT RNAi agent are modified nucleotides. The MAPT RNAi agents disclosed herein may further be comprised of one or more modified internucleoside linkages, e.g., one or more phosphorothioate linkages. In some embodiments, a MAPT RNAi agent contains one or more modified nucleotides and one or more modified internucleoside linkages. In some embodiments, a 2'-modified nucleotide is combined with modified internucleoside linkage.

In some embodiments, a MAPT RNAi agent is prepared or provided as a salt, mixed salt, or a free-acid. In some embodiments, a MAPT RNAi agent is prepared as a pharmaceutically acceptable salt. In some embodiments, a MAPT RNAi agent is prepared as a pharmaceutically acceptable sodium salt. Such forms that are well known in the art are within the scope of the inventions disclosed herein.

Modified Nucleotides

Modified nucleotides, when used in various oligonucleotide constructs, can preserve activity of the compound in cells while at the same time increasing the serum stability of these compounds, and can also minimize the possibility of activating interferon activity in humans upon administration of the oligonucleotide construct.

In some embodiments, a MAPT RNAi agent contains one or more modified nucleotides. As used herein, a "modified nucleotide" is a nucleotide other than a ribonucleotide (2'-hydroxyl nucleotide). In some embodiments, at least 50% (e.g., at least 60%, at least 70%, at least 80%, at least 90%, at least 95%, at least 97%, at least 98%, at least 99%, or 100%) of the nucleotides are modified nucleotides. As used herein, modified nucleotides can include, but are not limited to, deoxyribonucleotides, nucleotide mimics, abasic nucleotides, 2'-modified nucleotides, inverted nucleotides, modified nucleobase-comprising nucleotides, bridged nucleotides, peptide nucleic acids (PNAs), 2',3'-seco nucleotide mimics (unlocked nucleobase analogues), locked nucleotides, 3'-O-methoxy (2' internucleoside linked) nucleotides, 2'-F-Arabino nucleotides, 5'-Me, 2'-fluoro nucleotide, morpholino nucleotides, vinyl phosphonate deoxyribonucleotides, vinyl phosphonate containing nucleotides, and cyclopropyl phosphonate containing nucleotides. 2'-modified nucleotides (i.e., a nucleotide with a group other than a hydroxyl group at the 2' position of the five-membered sugar ring) include, but are not limited to, 2'-O-methyl nucleotides (also referred to herein or in the art as 2'-methoxy nucleotides), 2'-fluoro nucleotides (also referred to herein or in the art as 2'-deoxy-2'-fluoro nucleotides), 2'-deoxy nucleotides, 2'-methoxyethyl (2'-O-2-methoxylethyl) nucleotides (also referred herein or in the art as 2'-MOE nucleotides), 2'-amino nucleotides, and 2'-alkyl nucleotides. It is not necessary for all positions in a given compound to be uniformly modified. Conversely, more than one modification can be incorporated in a single MAPT RNAi agent or even in a single nucleotide thereof. The MAPT RNAi agent sense strands and antisense strands can be synthesized and/or modified by methods known in the art. Modification at one nucleotide is independent of modification at another nucleotide.

Modified nucleobases include synthetic and natural nucleobases, such as 5-substituted pyrimidines, 6-azapyrimidines and N-2, N-6 and 0-6 substituted purines, (e.g., 2-aminopropyladenine, 5-propynyluracil, or 5-propynylcytosine), 5-methylcytosine (5-me-C), 5-hydroxymethyl cytosine, inosine, xanthine, hypoxanthine, 2-aminoadenine, 6-alkyl (e.g., 6-methyl, 6-ethyl, 6-isopropyl, or 6-n-butyl) derivatives of adenine and guanine, 2-alkyl (e.g., 2-methyl, 2-ethyl, 2-isopropyl, or 2-n-butyl) and other alkyl derivatives of adenine and guanine, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7-methylguanine and 7-methyladenine, 8-azaguanine and 8-azaadenine, 7-deazaguanine, 7-deazaadenine, 3-deazaguanine, and 3-deazaadenine.

In some embodiments, the 5' and/or 3' end of the antisense strand can include abasic residues (Ab), which can also be referred to as an "abasic site" or "abasic nucleotide." An abasic residue (Ab) is a nucleotide or nucleoside that lacks a nucleobase at the 1' position of the sugar moiety. (See, e.g., U.S. Pat. No. 5,998,203). In some embodiments, an abasic residue can be placed internally in a nucleotide sequence. In some embodiments, Ab or AbAb can be added to the 3' end of the antisense strand. In some embodiments, the 5' end of the sense strand can include one or more additional abasic residues (e.g., (Ab) or (AbAb)). In some embodiments, UUAb, UAb, or Ab are added to the 3' end of the sense strand. In some embodiments, an abasic (deoxyribose) residue can be replaced with a ribitol (abasic ribose) residue.

In some embodiments, all or substantially all of the nucleotides of an RNAi agent are modified nucleotides. As used herein, an RNAi agent wherein substantially all of the nucleotides present are modified nucleotides is an RNAi agent having four or fewer (i.e., 0, 1, 2, 3, or 4) nucleotides in both the sense strand and the antisense strand being ribonucleotides (i.e., unmodified). As used herein, a sense strand wherein substantially all of the nucleotides present are modified nucleotides is a sense strand having two or fewer (i.e., 0, 1, or 2) nucleotides in the sense strand being unmodified ribonucleotides. As used herein, an antisense strand wherein substantially all of the nucleotides present are modified nucleotides is an antisense strand having two or fewer (i.e., 0, 1, or 2) nucleotides in the antisense strand being unmodified ribonucleotides. In some embodiments, one or more nucleotides of an RNAi agent is an unmodified ribonucleotide. Chemical structures for certain modified nucleotides are set forth in Table 10 herein.

Modified Internucleoside Linkages

In some embodiments, one or more nucleotides of a MAPT RNAi agent are linked by non-standard linkages or backbones (i.e., modified internucleoside linkages or modified backbones). Modified internucleoside linkages or backbones include, but are not limited to, phosphorothioate groups (represented herein as a lower case "s"), chiral phosphorothioates, thiophosphates, phosphorodithioates, phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some embodiments, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide backbones, sulfoxide backbones, sulfone backbones, formacetyl and thioformacetyl backbones, methylene formacetyl and thioformacetyl backbones, alkene-containing backbones, sulfamate backbones, methyleneimino and methylenehydrazino backbones, sulfonate and sulfonamide backbones, amide backbones, and other backbones having mixed N, O, S, and $CH_2$ components.

In some embodiments, a sense strand of a MAPT RNAi agent can contain 1, 2, 3, 4, 5, or 6 phosphorothioate linkages, an antisense strand of a MAPT RNAi agent can contain 1, 2, 3, 4, 5, or 6 phosphorothioate linkages, or both the sense strand and the antisense strand independently can contain 1, 2, 3, 4, 5, or 6 phosphorothioate linkages. In some embodiments, a sense strand of a MAPT RNAi agent can contain 1, 2, 3, or 4 phosphorothioate linkages, an antisense strand of a MAPT RNAi agent can contain 1, 2, 3, or 4 phosphorothioate linkages, or both the sense strand and the antisense strand independently can contain 1, 2, 3, or 4 phosphorothioate linkages.

In some embodiments, a MAPT RNAi agent sense strand contains at least two phosphorothioate internucleoside linkages. In some embodiments, the phosphorothioate internucleoside linkages are between the nucleotides at positions 1-3 from the 3' end of the sense strand. In some embodiments, one phosphorothioate internucleoside linkage is at the 5' end of the sense strand nucleotide sequence, and another phosphorothioate linkage is at the 3' end of the sense strand nucleotide sequence. In some embodiments, two phosphorothioate internucleoside linkage are located at the 5' end of the sense strand, and another phosphorothioate linkage is at the 3' end of the sense strand. In some embodiments, the sense strand does not include any phosphorothioate internucleoside linkages between the nucleotides, but contains one, two, or three phosphorothioate linkages between the terminal nucleotides on both the 5' and 3' ends and the optionally present inverted abasic residue terminal caps. In some embodiments, a targeting ligand is linked to the sense strand via a phosphorothioate linkage.

In some embodiments, a MAPT RNAi agent antisense strand contains four phosphorothioate internucleoside linkages. In some embodiments, the four phosphorothioate internucleoside linkages are between the nucleotides at positions 1-3 from the 5' end of the antisense strand and between the nucleotides at positions 19-21, 20-22, 21-23, 22-24, 23-25, or 24-26 from the 5' end. In some embodiments, three phosphorothioate internucleoside linkages are located between positions 1-4 from the 5' end of the antisense strand, and a fourth phosphorothioate internucleoside linkage is located between positions 20-21 from the 5' end of the antisense strand. In some embodiments, a MAPT RNAi agent contains at least three or four phosphorothioate internucleoside linkages in the antisense strand.

Capping Residues or Moieties

In some embodiments, the sense strand may include one or more capping residues or moieties, sometimes referred to in the art as a "cap," a "terminal cap," or a "capping residue." As used herein, a "capping residue" is a non-nucleotide compound or other moiety that can be incorporated at one or more termini of a nucleotide sequence of an RNAi agent disclosed herein. A capping residue can provide the RNAi agent, in some instances, with certain beneficial properties, such as, for example, protection against exonuclease degradation. In some embodiments, inverted abasic residues (invAb) (also referred to in the art as "inverted abasic sites") are added as capping residues (see Table 10). (See, e.g., F. Czauderna, Nucleic Acids Res., 2003, 31(11), 2705-16). Capping residues are generally known in the art, and include, for example, inverted abasic residues as well as carbon chains such as a terminal $C_3H_7$ (propyl), $C_6H_{13}$ (hexyl), or $C_{12}H_{25}$ (dodecyl) groups. In some embodiments, a capping residue is present at either the 5' terminal end, the 3' terminal end, or both the 5' and 3' terminal ends of the sense strand. In some embodiments, the 5' end and/or the 3' end of the sense strand may include more than one inverted abasic deoxyribose moiety as a capping residue.

In some embodiments, one or more inverted abasic residues (invAb) are added to the 3' end of the sense strand. In some embodiments, one or more inverted abasic residues (invAb) are added to the 5' end of the sense strand. In some embodiments, one or more inverted abasic residues or inverted abasic sites are inserted between a targeting ligand and the nucleotide sequence of the sense strand of the RNAi agent. In some embodiments, the inclusion of one or more inverted abasic residues or inverted abasic sites at or near the terminal end or terminal ends of the sense strand of an RNAi agent allows for enhanced activity or other desired properties of an RNAi agent.

In some embodiments, one or more inverted abasic residues (invAb) are added to the 5' end of the sense strand. In some embodiments, one or more inverted abasic residues can be inserted between a targeting ligand and the nucleotide sequence of the sense strand of the RNAi agent. The inverted abasic residues may be linked via phosphate, phosphorothioate (e.g., shown herein as (invAb)s)), or other internucleoside linkages. In some embodiments, the inclusion of one or more inverted abasic residues at or near the terminal end or terminal ends of the sense strand of an RNAi agent may allow for enhanced activity or other desired properties of an RNAi agent. In some embodiments, an inverted abasic (deoxyribose) residue can be replaced with an inverted ribitol (abasic ribose) residue. In some embodiments, the 3' end of the antisense strand core stretch sequence, or the 3' end of the antisense strand sequence, may include an inverted abasic residue. The chemical structures for inverted abasic deoxyribose residues are shown in Table 10 below.

MAPT RNAi Agents

The MAPT RNAi agents disclosed herein are designed to target specific positions on a MAPT gene (e.g., SEQ ID NO: 1 (NM 001123066.4)). As defined herein, an antisense strand sequence is designed to target a MAPT gene at a given position on the gene when the 5' terminal nucleobase of the antisense strand is aligned with a position that is 21 nucleotides downstream (towards the 3' end) from the position on the gene when base pairing to the gene. For example, as illustrated in Tables 1 and 2 herein, an antisense strand sequence designed to target a MAPT gene at position 184 requires that when base pairing to the gene, the 5' terminal nucleobase of the antisense strand is aligned with position 204 of a MAPT gene.

As provided herein, a MAPT RNAi agent does not require that the nucleobase at position 1 (5'→3') of the antisense strand be complementary to the gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. For example, for a MAPT RNAi agent disclosed herein that is designed to target position 184 of a MAPT gene, the 5' terminal nucleobase of the antisense strand of the of the MAPT RNAi agent must be aligned with position 204 of the gene; however, the 5' terminal nucleobase of the antisense strand may be, but is not required to be, complementary to position 204 of a MAPT gene, provided that there is at least 85% complementarity (e.g., at least 85, 86, 87, 88, 89, 90, 91, 92, 93, 94, 95, 96, 97, 98, 99, or 100% complementarity) of the antisense strand and the gene transcript across a core stretch sequence of at least 16 consecutive nucleotides. As shown by, among other things, the various examples disclosed herein, the specific site of binding of the gene by the antisense strand of the MAPT RNAi agent (e.g., whether the MAPT RNAi agent is designed to target a MAPT gene at position 184, at position 185, at position 246, or at some other position) is an important factor to the level of inhibition achieved by the MAPT RNAi agent. (See, e.g., Kamola et al., *The siRNA Non-seed Region and Its Target Sequences are Auxiliary Determinants of Off-Target Effects*, PLOS Computational Biology, 11(12), FIG. 1 (2015)).

In some embodiments, the MAPT RNAi agents disclosed herein target a MAPT gene at or near the positions of the MAPT sequence shown in Table P. In some embodiments, the antisense strand of a MAPT RNAi agent disclosed herein includes a core stretch sequence that is fully, substantially, or at least partially complementary to a target MAPT 19-mer sequence disclosed in Table 1.

TABLE 1

MAPT 19-mer mRNA Target Sequences (taken from *homo sapiens* microtubule associated protein tau (MAPT) transcript, GenBank NM_016834.5 (SEQ ID NO: 1))

| SEQ ID No. | MAPT 19-mer Target Sequences (5'→3') | Corresponding Positions of Sequence on SEQ ID NO: 1 | Targeted Gene Position (as referred to herein) |
|---|---|---|---|
| 44 | AGAUCACGCUGGGACGUAC | 186-204 | 184 |
| 45 | GAUCACGCUGGGACGUACG | 187-205 | 185 |
| 46 | AAGACCAAGAGGGUGACAC | 248-266 | 246 |
| 47 | AGACGAAGCUGCUGGUCAC | 321-339 | 319 |
| 48 | GACCCAAGCUCGCAUGGUC | 342-360 | 340 |
| 49 | AAGCUCGCAUGGUCAGUAA | 347-365 | 345 |
| 50 | GCUCGCAUGGUCAGUAAAA | 349-367 | 347 |
| 51 | UCGCAUGGUCAGUAAAAGC | 351-369 | 349 |
| 52 | GCAUGGUCAGUAAAAGCAA | 353-371 | 351 |
| 53 | CAUGGUCAGUAAAAGCAAA | 354-372 | 352 |
| 54 | UCAGUAAAAGCAAAGACGG | 359-377 | 357 |
| 55 | GACUGGAAGCGAUGACAAA | 378-396 | 376 |

TABLE 1-continued

MAPT 19-mer mRNA Target Sequences (taken from *homo sapiens* microtubule associated protein tau (MAPT) transcript, GenBank NM_016834.5 (SEQ ID NO: 1))

| SEQ ID No. | MAPT 19-mer Target Sequences (5'→3') | Corresponding Positions of Sequence on SEQ ID NO: 1 | Targeted Gene Position (as referred to herein) |
|---|---|---|---|
| 56 | CUGGAAGCGAUGACAAAAA | 380-398 | 378 |
| 57 | GAAGCGAUGACAAAAAAGC | 383-401 | 381 |
| 58 | CAGGAUUCCAGCAAAAACC | 483-501 | 481 |
| 59 | AGGAUUCCAGCAAAAACCC | 484-502 | 482 |
| 60 | AAGACACCACCCAGCUCUG | 514-532 | 512 |
| 61 | UGGUGAACCUCCAAAAUCA | 531-549 | 529 |
| 62 | GGUGAACCUCCAAAAUCAG | 532-550 | 530 |
| 63 | UGAACCUCCAAAAUCAGGG | 534-552 | 532 |
| 64 | CAAAAUCAGGGGAUCGCAG | 542-560 | 540 |
| 65 | GUGCAAAUAGUCUACAAAC | 892-910 | 890 |
| 66 | AAUAGUCUACAAACCAGUU | 897-915 | 895 |
| 67 | UAGUCUACAAACCAGUUGA | 899-917 | 897 |
| 68 | AGUCUACAAACCAGUUGAC | 900-918 | 898 |
| 69 | UCUACAAACCAGUUGACCU | 902-920 | 900 |
| 70 | CCAGUUGACCUGAGCAAGG | 910-928 | 908 |
| 71 | GUUGACCUGAGCAAGGUGA | 913-931 | 911 |
| 72 | AAGGUGACCUCCAAGUGUG | 925-943 | 923 |
| 73 | CUCCAAGUGUGGCUCAUUA | 933-951 | 931 |
| 74 | UCCAAGUGUGGCUCAUUAG | 934-952 | 932 |
| 75 | CCAAGUGUGGCUCAUUAGG | 935-953 | 933 |
| 76 | CAAGUGUGGCUCAUUAGGC | 936-954 | 934 |
| 77 | AAGUGUGGCUCAUUAGGCA | 937-955 | 935 |
| 78 | GGCUCAUUAGGCAACAUCC | 943-961 | 941 |
| 79 | UAGGCAACAUCCAUCAUAA | 950-968 | 948 |
| 80 | AGGCAACAUCCAUCAUAAA | 951-969 | 949 |
| 81 | GCAACAUCCAUCAUAAACC | 953-971 | 951 |
| 82 | GUGGCCAGGUGGAAGUAAA | 977-995 | 975 |
| 83 | CCAGGUGGAAGUAAAAUCU | 981-999 | 979 |
| 84 | CAGGUGGAAGUAAAAUCUG | 982-1000 | 980 |
| 85 | GGUCCUGGACAAUAUCAC | 1040-1058 | 1038 |
| 86 | UCCCUGGACAAUAUCACCC | 1042-1060 | 1040 |
| 87 | AGAUUGAAACCCACAAGCU | 1085-1103 | 1083 |
| 88 | AUUGAAACCCACAAGCUGA | 1087-1105 | 1085 |

TABLE 1-continued

MAPT 19-mer mRNA Target Sequences (taken from *homo sapiens* microtubule associated protein tau (MAPT) transcript, GenBank NM_016834.5 (SEQ ID NO: 1))

| SEQ ID No. | MAPT 19-mer Target Sequences (5'→3') | Corresponding Positions of Sequence on SEQ ID NO: 1 | Targeted Gene Position (as referred to herein) |
|---|---|---|---|
| 89 | UUGAAACCCACAAGCUGAC | 1088-1106 | 1086 |
| 90 | GCCAAAGCCAAGACAGACC | 1120-1138 | 1118 |
| 91 | CAGCAUCGACAUGGUAGAC | 1221-1239 | 1219 |
| 92 | GCAUCGACAUGGUAGACUC | 1223-1241 | 1221 |

*Homo sapiens* microtubule associated protein tau (MAPT), GenBank NM_016834.5 (SEQ ID NO: 1), gene transcript (5465 bases):

```
   1 gcagtcaccg ccacccacca gctccggcac caacagcagc gccgctgcca ccgcccacct
  61 tctgccgccg ccaccacagc caccttctcc tcctccgctg tcctctcccg tcctcgcctc
 121 tgtcgactat caggtgaact ttgaaccagg atggctgagc ccgccaggag gttcgaagtg
 181 atggaagatc acgctgggac gtacggggttg ggggacagga aagatcaggg gggctacacc
 241 atgcaccaag accaagaggg tgacacggac gctggcctga agctgaaga agcaggcatt
 301 ggagacaccc ccagcctgga agacgaagct gctggtcacg tgacccaagc tcgcatggtc
 361 agtaaaagca agacgggac tggaagcgat gacaaaaaag ccaagggggc tgatggtaaa
 421 acgaagatcg ccacaccgcg gggagcagcc cctccaggcc agaagggcca ggccaacgcc
 481 accaggattc cagcaaaaac cccgcccgct ccaaagacac cacccagctc tggtgaacct
 541 ccaaaatcag gggatcgcag cggctacagc agccccggct ccccaggcac tcccggcagc
 601 cgctcccgca cccgtccct tccaacccca cccacccggg agccaagaa ggtggcagtg
 661 gtccgtactc cacccaagtc gccgtcttcc gccaagagcc gcctgcagac agccccccgtg
 721 cccatgccag acctgaagaa tgtcaagtcc aagatcggct ccactgaaa cctgaagcac
 781 cagccgggag gcgggaaggt gcagataatt aataagaagc tggatcttag caacgtccag
 841 tccaagtgtg gctcaaagga taatatcaaa cacgtcccgg gaggcggcag tgtgcaaata
 901 gtctacaaac cagttgacct gagcaaggtg acctccaagt gtggctcatt aggcaacatc
 961 catcataaac caggaggtgg ccaggtggaa gtaaaatctg agaagcttga cttcaaggac
1021 agagtccagt cgaagattgg gtccctggac aatatcaccc acgtccctgg cggaggaaat
1081 aaaaagattg aaacccacaa gctgaccttc cgcgagaacg ccaaagccaa gacagaccac
1141 ggggcggaga tcgtgtacaa gtcgccagtg gtgtctgggg acacgtctcc acggcatctc
1201 agcaatgtct cctccaccgg cagcatcgac atggtagact cgccccagct cgccacgcta
1261 gctgacgagg tgtctgcctc cctggccaag caggggtttgt gatcaggccc ctggggcggt
1321 caataattgt ggagaggaga gaatgagaga gtgtggaaaa aaaagaata atgacccggc
1381 ccccgccctc tgcccccagc tgctcctcgc agttcggtta attggttaat cacttaacct
1441 gcttttgtca ctcggctttg gctcgggact tcaaaatcag tgatgggagt aagagcaaat
1501 ttcatctttc caaattgatg ggtgggctag taataaaata tttaaaaaaa aacattcaaa
1561 aacatggcca catccaacat ttcctcaggc aattcctttt gattcttttt tcttccccct
1621 ccatgtagaa gagggagaag gagaggctct gaaagctgct tctgggggat ttcaagggac
1681 tggggggtgcc aaccacctct ggccctgttg tggggggtgtc acagaggcag tggcagcaac
```

-continued

```
1741  aaaggatttg aaacttggtg tgttcgtgga gccacaggca gacgatgtca accttgtgtg 1801  agtgtgacgg gggttggggt ggggcgggag gccacggggg aggccgaggc aggggctggg 1861  cagaggggag aggaagcaca agaagtggga gtgggagagg aagccacgtg ctggagagta 1921  gacatccccc tccttgccgc tgggagagcc aaggcctatg ccacctgcag cgtctgagcg 1981  gccgcctgtc cttggtggcc ggggtgggg gcctgctgtg ggtcagtgtg ccaccctctg 2041  cagggcagcc tgtgggagaa gggacagcgg gtaaaaagag aaggcaagct ggcaggaggg 2101  tggcacttcg tggatgacct ccttagaaaa gactgacctt gatgtcttga gagcgctggc 2161  ctcttcctcc ctccctgcag ggtaggggc ctgagttgag gggcttccct ctgctccaca 2221  gaaaccctgt tttattgagt tctgaaggtt ggaactgctg ccatgatttt ggccactttg 2281  cagacctggg actttagggc taaccagttc tctttgtaag gacttgtgcc tcttgggaga 2341  cgtccacccg tttccaagcc tgggccactg gcatctctgg agtgtgtggg ggtctgggag 2401  gcaggtcccg agcccctgt ccttcccacg gccactgcag tcaccccgtc tgcgccgctg 2461  tgctgttgtc tgccgtgaga gcccaatcac tgcctatacc cctcatcaca cgtcacaatg 2521  tcccgaattc ccagcctcac cacccttct cagtaatgac cctggttggt tgcaggaggt 2581  acctactcca tactgagggt gaaattaagg gaaggcaaag tccaggcaca agagtgggac 2641  cccagcctct cactctcagt tccactcatc caactgggac cctcaccacg aatctcatga 2701  tctgattcgg ttccctgtct cctcctcccg tcacagatgt gagccagggc actgctcagc 2761  tgtgacccta ggtgtttctg ccttgttgac atggagagag ccctttcccc tgagaaggcc 2821  tggccccttc ctgtgctgag cccacagcag caggctgggt gtcttggttg tcagtggtgg 2881  caccaggatg gaagggcaag gcacccaggg caggcccaca gtcccgctgt cccccacttg 2941  caccctagct tgtagctgcc aacctcccag acagcccagc ccgctgctca gctccacatg 3001  catagtatca gccctccaca cccgacaaag gggaacacac ccccttggaa atggttcttt 3061  tcccccagtc ccagctggaa gccatgctgt ctgttctgct ggagcagctg aacatataca 3121  tagatgttgc cctgccctcc ccatctgcac cctgttgagt tgtagttgga tttgtctgtt 3181  tatgcttgga ttcaccagag tgactatgat agtgaaaaga aaaaaaaaa aaaaaaagga 3241  cgcatgtatc ttgaaatgct tgtaaagagg tttctaaccc accctcacga ggtgtctctc 3301  acccccacac tgggactcgt gtggcctgtg tggtgccacc ctgctgggc ctcccaagtt 3361  ttgaaaggct ttcctcagca cctgggaccc aacagagacc agcttctagc agctaaggag 3421  gccgttcagc tgtgacgaag gcctgaagca caggattagg actgaagcga tgatgtcccc 3481  ttccctactt ccccttgggg ctccctgtgt cagggcacag actaggtctt gtggctggtc 3541  tggcttgcgg cgcgaggatg gttctctctg gtcatagccc gaagtctcat ggcagtccca 3601  aaggaggctt acaactcctg catcacaaga aaaaggaagc cactgccagc tgggggatc 3661  tgcagctccc agaagctccg tgagcctcag ccacccctca gactgggttc ctctccaagc 3721  tcgccctctg gaggggcagc gcagcctccc accaagggcc ctgcgaccac agcagggatt 3781  gggatgaatt gcctgtcctg gatctgctct agaggcccaa gctgcctgcc tgaggaagga 3841  tgacttgaca agtcaggaga cactgttccc aaagccttga ccagagcacc tcagcccgct
```

-continued

```
3901  gaccttgcac aaactccatc tgctgccatg agaaaaggga agccgccttt gcaaaacatt 3961  gctgcctaaa gaaactcagc agcctcaggc ccaattctgc cacttctggt ttgggtacag 4021  ttaaaggcaa ccctgaggga cttggcagta gaaatccagg gcctccctg gggctggcag 4081  cttcgtgtgc agctagagct ttacctgaaa ggaagtctct gggcccagaa ctctccacca 4141  agagcctccc tgccgttcgc tgagtcccag caattctcct aagttgaagg gatctgagaa 4201  ggagaaggaa atgtggggta gatttggtgg tggttagaga tatgcccccc tcattactgc 4261  caacagtttc ggctgcattt cttcacgcac ctcggttcct cttcctgaag ttcttgtgcc 4321  ctgctcttca gcaccatggg ccttcttata cggaaggctc tgggatctcc cccttgtggg 4381  gcaggctctt ggggccagcc taagatcatg gtttagggtg atcagtgctg gcagataaat 4441  tgaaaaggca cgctggcttg tgatcttaaa tgaggacaat cccccccaggg ctgggcactc 4501  ctcccctccc ctcacttctc ccacctgcag agccagtgtc cttgggtggg ctagatagga 4561  tatactgtat gccggctcct tcaagctgct gactcacttt atcaatagtt ccatttaaat 4621  tgacttcagt ggtgagactg tatcctgttt gctattgctt gttgtgctat gggggaggg 4681  gggaggaatg tgtaagatag ttaacatggg caaagggaga tcttggggtg cagcacttaa 4741  actgcctcgt aaccctttc atgatttcaa ccacatttgc tagagggagg gagcagccac 4801  ggagttagag gcccttgggg tttctctttt ccactgacag gctttcccag gcagctggct 4861  agttcattcc ctccccagcc aggtgcaggc gtaggaatat ggacatctgg ttgctttggc 4921  ctgctgccct ctttcagggg tcctaagccc acaatcatgc ctccctaaga ccttggcatc 4981  cttccctcta agccgttggc acctctgtgc cacctctcac actggctcca gacacacagc 5041  ctgtgctttt ggagctgaga tcactcgctt caccctcctc atctttgttc tccaagtaaa 5101  gccacgaggt cggggcgagg gcagaggtga tcacctgcgt gtcccatcta cagacctgca 5161  gcttcataaa acttctgatt tctcttcagc tttgaaaagg gttaccctgg gcactggcct 5221  agagcctcac ctcctaatag acttagcccc atgagtttgc catgttgagc aggactattt 5281  ctggcacttg caagtcccat gatttcttcg gtaattctga gggtgggggg agggacatga 5341  aatcatctta gcttagcttt ctgtctgtga atgtctatat agtgtattgt gtgttttaac 5401  aaatgattta cactgactgt tgctgtaaaa gtgaatttgg aaataaagtt attactctga 5461  ttaaa
```

In some embodiments, a MAPT RNAi agent includes an antisense strand wherein position 19 of the antisense strand (5'43') is capable of forming a base pair with position 1 of a 19-mer target sequence disclosed in Table 1. In some embodiments, a MAPT agent includes an antisense strand wherein position 1 of the antisense strand (5'43') is capable of forming a base pair with position 19 of a 19-mer target sequence disclosed in Table 1.

In some embodiments, a MAPT agent includes an antisense strand wherein position 2 of the antisense strand (5'→3') is capable of forming a base pair with position 18 of a 19-mer target sequence disclosed in Table 1. In some embodiments, a MAPT agent includes an antisense strand wherein positions 2 through 18 of the antisense strand (5'→3') are capable of forming base pairs with each of the respective complementary bases located at positions 18 through 2 of the 19-mer target sequence disclosed in Table 1.

For the RNAi agents disclosed herein, the nucleotide at position 1 of the antisense strand (from 5' end→3') can be perfectly complementary to a MAPT gene, or can be non-complementary to a MAPT gene. In some embodiments, the nucleotide at position 1 of the antisense strand (from 5' end→3' end) is a U, A, or dT. In some embodiments, the nucleotide at position 1 of the antisense strand (from 5' end→3' end) forms an A:U or U:A base pair with the sense strand.

In some embodiments, a MAPT RNAi agent antisense strand comprises the sequence of nucleotides (from 5' end→3' end) 2-18 or 2-19 of any of the antisense strand sequences in Table 2 or Table 3. In some embodiments, a MAPT RNAi sense strand comprises the sequence of nucleotides (from 5' end→3' end) 1-17, 1-18, or 2-18 of any of the sense strand sequences in Table 2, Table 4, Table 5, or Table 6.

In some embodiments, a MAPT RNAi agent is comprised of (i) an antisense strand comprising the sequence of nucleotides (from 5' end→3' end) 2-18 or 2-19 of any of the antisense strand sequences in Table 2 or Table 3, and (ii) a sense strand comprising the sequence of nucleotides (from 5' end→3' end) 1-17 or 1-18 of any of the sense strand sequences in Table 2, Table 4, Table 5, or Table 6.

In some embodiments, the MAPT RNAi agents include core 19-mer nucleotide sequences shown in the following Table 2.

TABLE 2

MAPT RNAi Agent Antisense Strand and Sense Strand Core Stretch Base Sequences
(N = any nucleobase; I = inosine (hypoxanthine nucleobase)

| SEQ ID NO: | Antisense Strand Base Sequence (5'→3') (Shown as an Unmodified Nucleotide Sequence) | SEQ ID NO: | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 93 | UUACGUCCCAGCGUGAUCU | 319 | AGAUCACGCUGGGACGUAA | 186-204 | 184 |
| 94 | AUACGUCCCAGCGUGAUCU | 320 | AGAUCACGCUGGGACGUAU | 186-204 | 184 |
| 95 | GUACGUCCCAGCGUGAUCU | 321 | AGAUCACGCUGGGACGUAC | 186-204 | 184 |
| 96 | NUACGUCCCAGCGUGAUCU | 322 | AGAUCACGCUGGGACGUAN | 186-204 | 184 |
| 97 | NUACGUCCCAGCGUGAUCN | 323 | NGAUCACGCUGGGACGUAN | 186-204 | 184 |
| 98 | UGUACGUCCCAGCGUGAUC | 324 | GAUCACGCUGGGACGUACA | 187-205 | 185 |
| 99 | AGUACGUCCCAGCGUGAUC | 325 | GAUCACGCUGGGACGUACU | 187-205 | 185 |
| 100 | CGUACGUCCCAGCGUGAUC | 326 | GAUCACGCUGGGACGUACG | 187-205 | 185 |
| 101 | NGUACGUCCCAGCGUGAUC | 327 | GAUCACGCUGGGACGUACN | 187-205 | 185 |
| 102 | NGUACGUCCCAGCGUGAUN | 328 | NAUCACGCUGGGACGUACN | 187-205 | 185 |
| 103 | UUGUCACCCUCUUGGUCUU | 329 | AAGACCAAGAGGGUGACAA | 248-266 | 246 |
| 104 | AUGUCACCCUCUUGGUCUU | 330 | AAGACCAAGAGGGUGACAU | 248-266 | 246 |
| 105 | GUGUCACCCUCUUGGUCUU | 331 | AAGACCAAGAGGGUGACAC | 248-266 | 246 |
| 106 | NUGUCACCCUCUUGGUCUU | 332 | AAGACCAAGAGGGUGACAN | 248-266 | 246 |
| 107 | NUGUCACCCUCUUGGUCUN | 333 | NAGACCAAGAGGGUGACAN | 248-266 | 246 |
| 108 | UUGACCAGCAGCUUCGUCU | 334 | AGACGAAGCUGCUGGUCAA | 321-339 | 319 |
| 109 | AUGACCAGCAGCUUCGUCU | 335 | AGACGAAGCUGCUGGUCAU | 321-339 | 319 |
| 110 | GUGACCAGCAGCUUCGUCU | 336 | AGACGAAGCUGCUGGUCAC | 321-339 | 319 |
| 111 | NUGACCAGCAGCUUCGUCU | 337 | AGACGAAGCUGCUGGUCAN | 321-339 | 319 |
| 112 | NUGACCAGCAGCUUCGUCN | 338 | NGACGAAGCUGCUGGUCAN | 321-339 | 319 |
| 113 | UACCAUGCGAGCUUGGGUC | 339 | GACCCAAGCUCGCAUGGUA | 342-360 | 340 |
| 114 | AACCAUGCGAGCUUGGGUC | 340 | GACCCAAGCUCGCAUGGUU | 342-360 | 340 |
| 115 | GACCAUGCGAGCUUGGGUC | 341 | GACCCAAGCUCGCAUGGUC | 342-360 | 340 |
| 116 | NACCAUGCGAGCUUGGGUC | 342 | GACCCAAGCUCGCAUGGUN | 342-360 | 340 |
| 117 | NACCAUGCGAGCUUGGGUN | 343 | NACCCAAGCUCGCAUGGUN | 342-360 | 340 |
| 118 | AUACUGACCAUGCGAGCUU | 344 | AAGCUCGCAUGGUCAGUAU | 347-365 | 345 |
| 119 | UUACUGACCAUGCGAGCUU | 345 | AAGCUCGCAUGGUCAGUAA | 347-365 | 345 |
| 120 | NUACUGACCAUGCGAGCUU | 346 | AAGCUCGCAUGGUCAGUAN | 347-365 | 345 |
| 121 | NUACUGACCAUGCGAGCUN | 347 | NAGCUCGCAUGGUCAGUAN | 347-365 | 345 |
| 122 | AUUUACUGACCAUGCGAGC | 348 | GCUCGCAUGGUCAGUAAAU | 349-367 | 347 |
| 123 | UUUUACUGACCAUGCGAGC | 349 | GCUCGCAUGGUCAGUAAAA | 349-367 | 347 |
| 124 | NUUUACUGACCAUGCGAGC | 350 | GCUCGCAUGGUCAGUAAAN | 349-367 | 347 |
| 125 | NUUUACUGACCAUGCGAGN | 351 | NCUCGCAUGGUCAGUAAAN | 349-367 | 347 |
| 126 | UCUUUUACUGACCAUGCGA | 352 | UCGCAUGGUCAGUAAAAGA | 351-369 | 349 |
| 127 | ACUUUUACUGACCAUGCGA | 353 | UCGCAUGGUCAGUAAAAGU | 351-369 | 349 |
| 128 | GCUUUUACUGACCAUGCGA | 354 | UCGCAUGGUCAGUAAAAGC | 351-369 | 349 |

TABLE 2-continued

MAPT RNAi Agent Antisense Strand and Sense Strand Core Stretch Base Sequences
(N = any nucleobase; I = inosine (hypoxanthine nucleobase)

| SEQ ID NO: | Antisense Strand Base Sequence (5'→3') (Shown as an Unmodified Nucleotide Sequence) | SEQ ID NO: | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 129 | NCUUUUACUGACCAUGCGA | 355 | UCGCAUGGUCAGUAAAAGN | 351-369 | 349 |
| 130 | NCUUUUACUGACCAUGCGN | 356 | NCGCAUGGUCAGUAAAAGN | 351-369 | 349 |
| 131 | AUGCUUUUACUGACCAUGC | 357 | GCAUGGUCAGUAAAAGCAU | 353-371 | 351 |
| 132 | UUGCUUUUACUGACCAUGC | 358 | GCAUGGUCAGUAAAAGCAA | 353-371 | 351 |
| 133 | NUGCUUUUACUGACCAUGC | 359 | GCAUGGUCAGUAAAAGCAN | 353-371 | 351 |
| 134 | NUGCUUUUACUGACCAUGN | 360 | NCAUGGUCAGUAAAAGCAN | 353-371 | 351 |
| 135 | AUUGCUUUUACUGACCAUG | 361 | CAUGGUCAGUAAAAGCAAU | 354-372 | 352 |
| 136 | UUUGCUUUUACUGACCAUG | 362 | CAUGGUCAGUAAAAGCAAA | 354-372 | 352 |
| 137 | NUUGCUUUUACUGACCAUG | 363 | CAUGGUCAGUAAAAGCAAN | 354-372 | 352 |
| 138 | NUUGCUUUUACUGACCAUN | 364 | NAUGGUCAGUAAAAGCAAN | 354-372 | 352 |
| 139 | UCGUCUUUGCUUUUACUGA | 365 | UCAGUAAAAGCAAAGACGA | 359-377 | 357 |
| 140 | ACGUCUUUGCUUUUACUGA | 366 | UCAGUAAAAGCAAAGACGU | 359-377 | 357 |
| 141 | CCGUCUUUGCUUUUACUGA | 367 | UCAGUAAAAGCAAAGACGG | 359-377 | 357 |
| 142 | NCGUCUUUGCUUUUACUGA | 368 | UCAGUAAAAGCAAAGACGN | 359-377 | 357 |
| 143 | NCGUCUUUGCUUUUACUGN | 369 | NCAGUAAAAGCAAAGACGN | 359-377 | 357 |
| 144 | AUUGUCAUCGCUUCCAGUC | 370 | GACUGGAAGCGAUGACAAU | 378-396 | 376 |
| 145 | UUUGUCAUCGCUUCCAGUC | 371 | GACUGGAAGCGAUGACAAA | 378-396 | 376 |
| 146 | NUUGUCAUCGCUUCCAGUC | 372 | GACUGGAAGCGAUGACAAN | 378-396 | 376 |
| 147 | NUUGUCAUCGCUUCCAGUN | 373 | NACUGGAAGCGAUGACAAN | 378-396 | 376 |
| 148 | AUUUGUCAUCGCUUCCAG | 374 | CUGGAAGCGAUGACAAAAU | 380-398 | 378 |
| 149 | UUUUGUCAUCGCUUCCAG | 375 | CUGGAAGCGAUGACAAAAA | 380-398 | 378 |
| 150 | NUUUGUCAUCGCUUCCAG | 376 | CUGGAAGCGAUGACAAAAN | 380-398 | 378 |
| 151 | NUUUGUCAUCGCUUCCAN | 377 | NUGGAAGCGAUGACAAAAN | 380-398 | 378 |
| 152 | UCUUUUUUGUCAUCGCUUC | 378 | GAAGCGAUGACAAAAAAGA | 383-401 | 381 |
| 153 | ACUUUUUUGUCAUCGCUUC | 379 | GAAGCGAUGACAAAAAAGU | 383-401 | 381 |
| 154 | GCUUUUUUGUCAUCGCUUC | 380 | GAAGCGAUGACAAAAAAGC | 383-401 | 381 |
| 155 | NCUUUUUUGUCAUCGCUUC | 381 | GAAGCGAUGACAAAAAAGN | 383-401 | 381 |
| 156 | NCUUUUUUGUCAUCGCUUN | 382 | NAAGCGAUGACAAAAAAGN | 383-401 | 381 |
| 157 | UGUUUUUGCUGGAAUCCUG | 383 | CAGGAUUCCAGCAAAAACA | 483-501 | 481 |
| 158 | AGUUUUUGCUGGAAUCCUG | 384 | CAGGAUUCCAGCAAAAACU | 483-501 | 481 |
| 159 | GGUUUUUGCUGGAAUCCUG | 385 | CAGGAUUCCAGCAAAAACC | 483-501 | 481 |
| 160 | NGUUUUUGCUGGAAUCCUG | 386 | CAGGAUUCCAGCAAAAACN | 483-501 | 481 |
| 161 | NGUUUUUGCUGGAAUCCUN | 387 | NAGGAUUCCAGCAAAAACN | 483-501 | 481 |
| 162 | UGGUUUUUGCUGGAAUCCU | 388 | AGGAUUCCAGCAAAAACCA | 484-502 | 482 |
| 163 | AGGUUUUUGCUGGAAUCCU | 389 | AGGAUUCCAGCAAAAACCU | 484-502 | 482 |
| 164 | GGGUUUUUGCUGGAAUCCU | 390 | AGGAUUCCAGCAAAAACCC | 484-502 | 482 |

TABLE 2-continued

MAPT RNAi Agent Antisense Strand and Sense Strand Core Stretch Base Sequences
(N = any nucleobase; I = inosine (hypoxanthine nucleobase))

| SEQ ID NO: | Antisense Strand Base Sequence (5'→3') (Shown as an Unmodified Nucleotide Sequence) | SEQ ID NO: | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 165 | NGGUUUUUGCUGGAAUCCU | 391 | AGGAUCCAGCAAAAACCN | 484-502 | 482 |
| 166 | NGGUUUUUGCUGGAAUCCN | 392 | NGGAUCCAGCAAAAACCN | 484-502 | 482 |
| 167 | UAGAGCUGGGUGGUGUCUU | 393 | AAGACACCACCCAGCUCUA | 514-532 | 512 |
| 168 | AAGAGCUGGGUGGUGUCUU | 394 | AAGACACCACCCAGCUCUU | 514-532 | 512 |
| 169 | CAGAGCUGGGUGGUGUCUU | 395 | AAGACACCACCCAGCUCUG | 514-532 | 512 |
| 170 | NAGAGCUGGGUGGUGUCUU | 396 | AAGACACCACCCAGCUCUN | 514-532 | 512 |
| 171 | NAGAGCUGGGUGGUGUCUN | 397 | NAGACACCACCCAGCUCUN | 514-532 | 512 |
| 172 | AGAUUUUGGAGGUUCACCA | 398 | UGGUGAACCUCCAAAAUCU | 531-549 | 529 |
| 173 | UGAUUUUGGAGGUUCACCA | 399 | UGGUGAACCUCCAAAAUCA | 531-549 | 529 |
| 174 | NGAUUUUGGAGGUUCACCA | 400 | UGGUGAACCUCCAAAAUCN | 531-549 | 529 |
| 175 | NGAUUUUGGAGGUUCACCN | 401 | NGGUGAACCUCCAAAAUCN | 531-549 | 529 |
| 176 | UUGAUUUUGGAGGUUCACC | 402 | GGUGAACCUCCAAAAUCAA | 532-550 | 530 |
| 177 | AUGAUUUUGGAGGUUCACC | 403 | GGUGAACCUCCAAAAUCAU | 532-550 | 530 |
| 178 | CUGAUUUUGGAGGUUCACC | 404 | GGUGAACCUCCAAAAUCAG | 532-550 | 530 |
| 179 | NUGAUUUUGGAGGUUCACC | 405 | GGUGAACCUCCAAAAUCAN | 532-550 | 530 |
| 180 | NUGAUUUUGGAGGUUCACN | 406 | NGUGAACCUCCAAAAUCAN | 532-550 | 530 |
| 181 | UCCUGAUUUUGGAGGUUCA | 407 | UGAACCUCCAAAAUCAGGA | 534-552 | 532 |
| 182 | ACCUGAUUUUGGAGGUUCA | 408 | UGAACCUCCAAAAUCAGGU | 534-552 | 532 |
| 183 | CCCUGAUUUUGGAGGUUCA | 409 | UGAACCUCCAAAAUCAGGG | 534-552 | 532 |
| 184 | NCCUGAUUUUGGAGGUUCA | 410 | UGAACCUCCAAAAUCAGGN | 534-552 | 532 |
| 185 | NCCUGAUUUUGGAGGUUCN | 411 | NGAACCUCCAAAAUCAGGN | 534-552 | 532 |
| 186 | UUGCGAUCCCCUGAUUUUG | 412 | CAAAAUCAGGGGAUCGCAA | 542-560 | 540 |
| 187 | AUGCGAUCCCCUGAUUUUG | 413 | CAAAAUCAGGGGAUCGCAU | 542-560 | 540 |
| 188 | CUGCGAUCCCCUGAUUUUG | 414 | CAAAAUCAGGGGAUCGCAG | 542-560 | 540 |
| 189 | NUGCGAUCCCCUGAUUUUG | 415 | CAAAAUCAGGGGAUCGCAN | 542-560 | 540 |
| 190 | NUGCGAUCCCCUGAUUUUN | 416 | NAAAAUCAGGGGAUCGCAN | 542-560 | 540 |
| 191 | UUUUGUAGACUAUUUGCAC | 417 | GUGCAAAUAGUCUACAAAA | 892-910 | 890 |
| 192 | AUUUGUAGACUAUUUGCAC | 418 | GUGCAAAUAGUCUACAAAU | 892-910 | 890 |
| 193 | GUUUGUAGACUAUUUGCAC | 419 | GUGCAAAUAGUCUACAAAC | 892-910 | 890 |
| 194 | NUUUGUAGACUAUUUGCAC | 420 | GUGCAAAUAGUCUACAAAN | 892-910 | 890 |
| 195 | NUUUGUAGACUAUUUGCAN | 421 | NUGCAAAUAGUCUACAAAN | 892-910 | 890 |
| 196 | UACUGGUUUGUAGACUAUU | 422 | AAUAGUCUACAAACCAGUA | 897-915 | 895 |
| 197 | AACUGGUUUGUAGACUAUU | 423 | AAUAGUCUACAAACCAGUU | 897-915 | 895 |
| 198 | NACUGGUUUGUAGACUAUU | 424 | AAUAGUCUACAAACCAGUN | 897-915 | 895 |
| 199 | NACUGGUUUGUAGACUAUN | 425 | NAUAGUCUACAAACCAGUN | 897-915 | 895 |
| 200 | ACAACUGGUUUGUAGACUA | 426 | UAGUCUACAAACCAGUUGU | 899-917 | 897 |

TABLE 2-continued

MAPT RNAi Agent Antisense Strand and Sense Strand Core Stretch Base Sequences
(N = any nucleobase; I = inosine (hypoxanthine nucleobase))

| SEQ ID NO: | Antisense Strand Base Sequence (5'→3') (Shown as an Unmodified Nucleotide Sequence) | SEQ ID NO: | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 201 | UCAACUGGUUUGUAGACUA | 427 | UAGUCUACAAACCAGUUGA | 899-917 | 897 |
| 202 | NCAACUGGUUUGUAGACUA | 428 | UAGUCUACAAACCAGUUGN | 899-917 | 897 |
| 203 | NCAACUGGUUUGUAGACUN | 429 | NAGUCUACAAACCAGUUGN | 899-917 | 897 |
| 204 | UUCAACUGGUUUGUAGACU | 430 | AGUCUACAAACCAGUUGAA | 900-918 | 898 |
| 205 | AUCAACUGGUUUGUAGACU | 431 | AGUCUACAAACCAGUUGAU | 900-918 | 898 |
| 206 | GUCAACUGGUUUGUAGACU | 432 | AGUCUACAAACCAGUUGAC | 900-918 | 898 |
| 207 | NUCAACUGGUUUGUAGACU | 433 | AGUCUACAAACCAGUUGAN | 900-918 | 898 |
| 208 | NUCAACUGGUUUGUAGACN | 434 | NGUCUACAAACCAGUUGAN | 900-918 | 898 |
| 209 | UGGUCAACUGGUUUGUAGA | 435 | UCUACAAACCAGUUGACCA | 902-920 | 900 |
| 210 | AGGUCAACUGGUUUGUAGA | 436 | UCUACAAACCAGUUGACCU | 902-920 | 900 |
| 211 | NGGUCAACUGGUUUGUAGA | 437 | UCUACAAACCAGUUGACCN | 902-920 | 900 |
| 212 | NGGUCAACUGGUUUGUAGN | 438 | NCUACAAACCAGUUGACCN | 902-920 | 900 |
| 213 | UCUUGCUCAGGUCAACUGG | 439 | CCAGUUGACCUGAGCAAGA | 910-928 | 908 |
| 214 | ACUUGCUCAGGUCAACUGG | 440 | CCAGUUGACCUGAGCAAGU | 910-928 | 908 |
| 215 | CCUUGCUCAGGUCAACUGG | 441 | CCAGUUGACCUGAGCAAGG | 910-928 | 908 |
| 216 | NCUUGCUCAGGUCAACUGG | 442 | CCAGUUGACCUGAGCAAGN | 910-928 | 908 |
| 217 | NCUUGCUCAGGUCAACUGN | 443 | NCAGUUGACCUGAGCAAGN | 910-928 | 908 |
| 218 | ACACCUUGCUCAGGUCAAC | 444 | GUUGACCUGAGCAAGGUGU | 913-931 | 911 |
| 219 | UCACCUUGCUCAGGUCAAC | 445 | GUUGACCUGAGCAAGGUGA | 913-931 | 911 |
| 220 | NCACCUUGCUCAGGUCAAC | 446 | GUUGACCUGAGCAAGGUGN | 913-931 | 911 |
| 221 | NCACCUUGCUCAGGUCAAN | 447 | NUUGACCUGAGCAAGGUGN | 913-931 | 911 |
| 222 | UACACUUGGAGGUCACCUU | 448 | AAGGUGACCUCCAAGUGUA | 925-943 | 923 |
| 223 | AACACUUGGAGGUCACCUU | 449 | AAGGUGACCUCCAAGUGUU | 925-943 | 923 |
| 224 | CACACUUGGAGGUCACCUU | 450 | AAGGUGACCUCCAAGUGUG | 925-943 | 923 |
| 225 | NACACUUGGAGGUCACCUU | 451 | AAGGUGACCUCCAAGUGUN | 925-943 | 923 |
| 226 | NACACUUGGAGGUCACCUN | 452 | NAGGUGACCUCCAAGUGUN | 925-943 | 923 |
| 227 | AAAUGAGCCACACUUGGAG | 453 | CUCCAAGUGUGGCUCAUUU | 933-951 | 931 |
| 228 | UAAUGAGCCACACUUGGAG | 454 | CUCCAAGUGUGGCUCAUUA | 933-951 | 931 |
| 229 | NAAUGAGCCACACUUGGAG | 455 | CUCCAAGUGUGGCUCAUUN | 933-951 | 931 |
| 230 | NAAUGAGCCACACUUGGAN | 456 | NUCCAAGUGUGGCUCAUUN | 933-951 | 931 |
| 231 | UUAAUGAGCCACACUUGGA | 457 | UCCAAGUGUGGCUCAUUAA | 934-952 | 932 |
| 232 | AUAAUGAGCCACACUUGGA | 458 | UCCAAGUGUGGCUCAUUAU | 934-952 | 932 |
| 233 | CUAAUGAGCCACACUUGGA | 459 | UCCAAGUGUGGCUCAUUAG | 934-952 | 932 |
| 234 | NUAAUGAGCCACACUUGGA | 460 | UCCAAGUGUGGCUCAUUAN | 934-952 | 932 |
| 235 | NUAAUGAGCCACACUUGGN | 461 | NCCAAGUGUGGCUCAUUAN | 934-952 | 932 |
| 236 | UCUAAUGAGCCACACUUGG | 462 | CCAAGUGUGGCUCAUUAGA | 935-953 | 933 |

TABLE 2-continued

MAPT RNAi Agent Antisense Strand and Sense Strand Core Stretch Base Sequences
(N = any nucleobase; I = inosine (hypoxanthine nucleobase))

| SEQ ID NO: | Antisense Strand Base Sequence (5'→3') (Shown as an Unmodified Nucleotide Sequence) | SEQ ID NO: | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 237 | ACUAAUGAGCCACACUUGG | 463 | CCAAGUGUGGCUCAUUAGU | 935-953 | 933 |
| 238 | CCUAAUGAGCCACACUUGG | 464 | CCAAGUGUGGCUCAUUAGG | 935-953 | 933 |
| 239 | NCUAAUGAGCCACACUUGG | 465 | CCAAGUGUGGCUCAUUAGN | 935-953 | 933 |
| 240 | NCUAAUGAGCCACACUUGN | 466 | NCAAGUGUGGCUCAUUAGN | 935-953 | 933 |
| 241 | UCCUAAUGAGCCACACUUG | 467 | CAAGUGUGGCUCAUUAGGA | 936-954 | 934 |
| 242 | ACCUAAUGAGCCACACUUG | 468 | CAAGUGUGGCUCAUUAGGU | 936-954 | 934 |
| 243 | GCCUAAUGAGCCACACUUG | 469 | CAAGUGUGGCUCAUUAGGC | 936-954 | 934 |
| 244 | NCCUAAUGAGCCACACUUG | 470 | CAAGUGUGGCUCAUUAGGN | 936-954 | 934 |
| 245 | NCCUAAUGAGCCACACUUN | 471 | NAAGUGUGGCUCAUUAGGN | 936-954 | 934 |
| 246 | AGCCUAAUGAGCCACACUU | 472 | AAGUGUGGCUCAUUAGGCU | 937-955 | 935 |
| 247 | UGCCUAAUGAGCCACACUU | 473 | AAGUGUGGCUCAUUAGGCA | 937-955 | 935 |
| 248 | NGCCUAAUGAGCCACACUU | 474 | AAGUGUGGCUCAUUAGGCN | 937-955 | 935 |
| 249 | NGCCUAAUGAGCCACACUN | 475 | NAGUGUGGCUCAUUAGGCN | 937-955 | 935 |
| 250 | UGAUGUUGCCUAAUGAGCC | 476 | GGCUCAUUAGGCAACAUCA | 943-961 | 941 |
| 251 | AGAUGUUGCCUAAUGAGCC | 477 | GGCUCAUUAGGCAACAUCU | 943-961 | 941 |
| 252 | GGAUGUUGCCUAAUGAGCC | 478 | GGCUCAUUAGGCAACAUCC | 943-961 | 941 |
| 253 | NGAUGUUGCCUAAUGAGCC | 479 | GGCUCAUUAGGCAACAUCN | 943-961 | 941 |
| 254 | NGAUGUUGCCUAAUGAGCN | 480 | NGCUCAUUAGGCAACAUCN | 943-961 | 941 |
| 255 | AUAUGAUGGAUGUUGCCUA | 481 | UAGGCAACAUCCAUCAUAU | 950-968 | 948 |
| 256 | UUAUGAUGGAUGUUGCCUA | 482 | UAGGCAACAUCCAUCAUAA | 950-968 | 948 |
| 257 | NUAUGAUGGAUGUUGCCUA | 483 | UAGGCAACAUCCAUCAUAN | 950-968 | 948 |
| 258 | NUAUGAUGGAUGUUGCCUN | 484 | NAGGCAACAUCCAUCAUAN | 950-968 | 948 |
| 259 | AUUAUGAUGGAUGUUGCCU | 485 | AGGCAACAUCCAUCAUAAU | 951-969 | 949 |
| 260 | UUUAUGAUGGAUGUUGCCU | 486 | AGGCAACAUCCAUCAUAAA | 951-969 | 949 |
| 261 | NUUAUGAUGGAUGUUGCCU | 487 | AGGCAACAUCCAUCAUAAN | 951-969 | 949 |
| 262 | NUUAUGAUGGAUGUUGCCN | 488 | NGGCAACAUCCAUCAUAAN | 951-969 | 949 |
| 263 | UGUUUAUGAUGGAUGUUGC | 489 | GCAACAUCCAUCAUAAACA | 953-971 | 951 |
| 264 | AGUUUAUGAUGGAUGUUGC | 490 | GCAACAUCCAUCAUAAACU | 953-971 | 951 |
| 265 | GGUUUAUGAUGGAUGUUGC | 491 | GCAACAUCCAUCAUAAACC | 953-971 | 951 |
| 266 | NGUUUAUGAUGGAUGUUGC | 492 | GCAACAUCCAUCAUAAACN | 953-971 | 951 |
| 267 | NGUUUAUGAUGGAUGUUGN | 493 | NCAACAUCCAUCAUAAACN | 953-971 | 951 |
| 268 | AUUACUUCCACCUGGCCAC | 494 | GUGGCCAGGUGGAAGUAAU | 977-995 | 975 |
| 269 | UUUACUUCCACCUGGCCAC | 495 | GUGGCCAGGUGGAAGUAAA | 977-995 | 975 |
| 270 | NUUACUUCCACCUGGCCAC | 496 | GUGGCCAGGUGGAAGUAAN | 977-995 | 975 |
| 271 | NUUACUUCCACCUGGCCAN | 497 | NUGGCCAGGUGGAAGUAAN | 977-995 | 975 |
| 272 | UGAUUUUACUUCCACCUGG | 498 | CCAGGUGGAAGUAAAAUCA | 981-999 | 979 |

TABLE 2-continued

MAPT RNAi Agent Antisense Strand and Sense Strand Core Stretch Base Sequences
(N = any nucleobase; I = inosine (hypoxanthine nucleobase))

| SEQ ID NO: | Antisense Strand Base Sequence (5'→3') (Shown as an Unmodified Nucleotide Sequence) | SEQ ID NO: | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 273 | AGAUUUUACUUCCACCUGG | 499 | CCAGGUGGAAGUAAAAUCU | 981-999 | 979 |
| 274 | NGAUUUUACUUCCACCUGG | 500 | CCAGGUGGAAGUAAAAUCN | 981-999 | 979 |
| 275 | NGAUUUUACUUCCACCUGN | 501 | NCAGGUGGAAGUAAAAUCN | 981-999 | 979 |
| 276 | UAGAUUUUACUUCCACCUG | 502 | CAGGUGGAAGUAAAAUCUA | 982-1000 | 980 |
| 277 | AAGAUUUUACUUCCACCUG | 503 | CAGGUGGAAGUAAAAUCUU | 982-1000 | 980 |
| 278 | CAGAUUUUACUUCCACCUG | 504 | CAGGUGGAAGUAAAAUCUG | 982-1000 | 980 |
| 279 | NAGAUUUUACUUCCACCUG | 505 | CAGGUGGAAGUAAAAUCUN | 982-1000 | 980 |
| 280 | NAGAUUUUACUUCCACCUN | 506 | NAGGUGGAAGUAAAAUCUN | 982-1000 | 980 |
| 281 | UUGAUAUUGUCCAGGGACC | 507 | GGUCCCUGGACAAUAUCAA | 1040-1058 | 1038 |
| 282 | AUGAUAUUGUCCAGGGACC | 508 | GGUCCCUGGACAAUAUCAU | 1040-1058 | 1038 |
| 283 | GUGAUAUUGUCCAGGGACC | 509 | GGUCCCUGGACAAUAUCAC | 1040-1058 | 1038 |
| 284 | NUGAUAUUGUCCAGGGACC | 510 | GGUCCCUGGACAAUAUCAN | 1040-1058 | 1038 |
| 285 | NUGAUAUUGUCCAGGGACN | 511 | NGUCCCUGGACAAUAUCAN | 1040-1058 | 1038 |
| 286 | UGGUGAUAUUGUCCAGGGA | 512 | UCCCUGGACAAUAUCACCA | 1042-1060 | 1040 |
| 287 | AGGUGAUAUUGUCCAGGGA | 513 | UCCCUGGACAAUAUCACCU | 1042-1060 | 1040 |
| 288 | GGGUGAUAUUGUCCAGGGA | 514 | UCCCUGGACAAUAUCACCC | 1042-1060 | 1040 |
| 289 | NGGUGAUAUUGUCCAGGGA | 515 | UCCCUGGACAAUAUCACCN | 1042-1060 | 1040 |
| 290 | NGGUGAUAUUGUCCAGGGN | 516 | NCCCUGGACAAUAUCACCN | 1042-1060 | 1040 |
| 291 | UGCUUGUGGGUUUCAAUCU | 517 | AGAUUGAAACCCACAAGCA | 1085-1103 | 1083 |
| 292 | AGCUUGUGGGUUUCAAUCU | 518 | AGAUUGAAACCCACAAGCU | 1085-1103 | 1083 |
| 293 | NGCUUGUGGGUUUCAAUCU | 519 | AGAUUGAAACCCACAAGCN | 1085-1103 | 1083 |
| 294 | NGCUUGUGGGUUUCAAUCN | 520 | NGAUUGAAACCCACAAGCN | 1085-1103 | 1083 |
| 295 | ACAGCUUGUGGGUUUCAAU | 521 | AUUGAAACCCACAAGCUGU | 1087-1105 | 1085 |
| 296 | UCAGCUUGUGGGUUUCAAU | 522 | AUUGAAACCCACAAGCUGA | 1087-1105 | 1085 |
| 297 | NCAGCUUGUGGGUUUCAAU | 523 | AUUGAAACCCACAAGCUGN | 1087-1105 | 1085 |
| 298 | NCAGCUUGUGGGUUUCAAN | 524 | NUUGAAACCCACAAGCUGN | 1087-1105 | 1085 |
| 299 | UUCAGCUUGUGGGUUUCAA | 525 | UUGAAACCCACAAGCUGAA | 1088-1106 | 1086 |
| 300 | AUCAGCUUGUGGGUUUCAA | 526 | UUGAAACCCACAAGCUGAU | 1088-1106 | 1086 |
| 301 | GUCAGCUUGUGGGUUUCAA | 527 | UUGAAACCCACAAGCUGAC | 1088-1106 | 1086 |
| 302 | NUCAGCUUGUGGGUUUCAA | 528 | UUGAAACCCACAAGCUGAN | 1088-1106 | 1086 |
| 303 | NUCAGCUUGUGGGUUUCAN | 529 | NUGAAACCCACAAGCUGAN | 1088-1106 | 1086 |
| 304 | UGUCUGUCUUGGCUUUGGC | 530 | GCCAAAGCCAAGACAGACA | 1120-1138 | 1118 |
| 305 | AGUCUGUCUUGGCUUUGGC | 531 | GCCAAAGCCAAGACAGACU | 1120-1138 | 1118 |
| 306 | GGUCUGUCUUGGCUUUGGC | 532 | GCCAAAGCCAAGACAGACC | 1120-1138 | 1118 |
| 307 | NGUCUGUCUUGGCUUUGGC | 533 | GCCAAAGCCAAGACAGACN | 1120-1138 | 1118 |
| 308 | NGUCUGUCUUGGCUUUGGN | 534 | NCCAAAGCCAAGACAGACN | 1120-1138 | 1118 |

TABLE 2-continued

MAPT RNAi Agent Antisense Strand and Sense Strand Core Stretch Base Sequences
(N = any nucleobase; I = inosine (hypoxanthine nucleobase))

| SEQ ID NO: | Antisense Strand Base Sequence (5'→3') (Shown as an Unmodified Nucleotide Sequence) | SEQ ID NO: | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 309 | UUCUACCAUGUCGAUGCUG | 535 | CAGCAUCGACAUGGUAGAA | 1221-1239 | 1219 |
| 310 | AUCUACCAUGUCGAUGCUG | 536 | CAGCAUCGACAUGGUAGAU | 1221-1239 | 1219 |
| 311 | GUCUACCAUGUCGAUGCUG | 537 | CAGCAUCGACAUGGUAGAC | 1221-1239 | 1219 |
| 312 | NUCUACCAUGUCGAUGCUG | 538 | CAGCAUCGACAUGGUAGAN | 1221-1239 | 1219 |
| 313 | NUCUACCAUGUCGAUGCUN | 539 | NAGCAUCGACAUGGUAGAN | 1221-1239 | 1219 |
| 314 | UAGUCUACCAUGUCGAUGC | 540 | GCAUCGACAUGGUAGACUA | 1223-1241 | 1221 |
| 315 | AAGUCUACCAUGUCGAUGC | 541 | GCAUCGACAUGGUAGACUU | 1223-1241 | 1221 |
| 316 | GAGUCUACCAUGUCGAUGC | 542 | GCAUCGACAUGGUAGACUC | 1223-1241 | 1221 |
| 317 | NAGUCUACCAUGUCGAUGC | 543 | GCAUCGACAUGGUAGACUN | 1223-1241 | 1221 |
| 318 | NAGUCUACCAUGUCGAUGN | 544 | NCAUCGACAUGGUAGACUN | 1223-1241 | 1221 |

The MAPT RNAi agent sense strands and antisense strands that comprise or consist of the nucleotide sequences in Table 2 can be modified nucleotides or unmodified nucleotides. In some embodiments, the MAPT RNAi agents having the sense and antisense strand sequences that comprise or consist of any of the nucleotide sequences in Table 2 are all or substantially all modified nucleotides.

In some embodiments, the antisense strand of a MAPT RNAi agent disclosed herein differs by 0, 1, 2, or 3 nucleotides from any of the antisense strand sequences in Table 2. In some embodiments, the sense strand of a MAPT RNAi agent disclosed herein differs by 0, 1, 2, or 3 nucleotides from any of the sense strand sequences in Table 2.

As used herein, each N listed in a sequence disclosed in Table 2 may be independently selected from any and all nucleobases (including those found on both modified and unmodified nucleotides). In some embodiments, an N nucleotide listed in a sequence disclosed in Table 2 has a nucleobase that is complementary to the N nucleotide at the corresponding position on the other strand. In some embodiments, an N nucleotide listed in a sequence disclosed in Table 2 has a nucleobase that is not complementary to the N nucleotide at the corresponding position on the other strand. In some embodiments, an N nucleotide listed in a sequence disclosed in Table 2 has a nucleobase that is the same as the N nucleotide at the corresponding position on the other strand. In some embodiments, an N nucleotide listed in a sequence disclosed in Table 2 has a nucleobase that is different from the N nucleotide at the corresponding position on the other strand.

Certain modified MAPT RNAi agent sense and antisense strands are provided in Table 3, Table 4, Table 5, Table 6, and Table 10. Certain modified MAPT RNAi agent antisense strands, as well as their underlying unmodified nucleobase sequences, are provided in Table 3. Certain modified MAPT RNAi agent sense strands, as well as their underlying unmodified nucleobase sequences, are provided in Tables 4, 5, and 6. In forming MAPT RNAi agents, each of the nucleotides in each of the underlying base sequences listed in Tables 3, 4, 5, and 6, as well as in Table 2, above, can be a modified nucleotide.

The MAPT RNAi agents described herein are formed by annealing an antisense strand with a sense strand. A sense strand containing a sequence listed in Table 2, Table 4, Table 5, or Table 6, can be hybridized to any antisense strand containing a sequence listed in Table 2 or Table 3, provided the two sequences have a region of at least 85% complementarity over a contiguous 16, 17, 18, 19, 20, or 21 nucleotide sequence.

In some embodiments, a MAPT RNAi agent antisense strand comprises a nucleotide sequence of any of the sequences in Table 2 or Table 3.

In some embodiments, a MAPT RNAi agent comprises or consists of a duplex having the nucleobase sequences of the sense strand and the antisense strand of any of the sequences in Table 2, Table 3, Table 4, Table 5, Table 6, or Table 9.

Examples of antisense strands containing modified nucleotides are provided in Table 3. Examples of sense strands containing modified nucleotides are provided in Tables 4, 5 and 6.

As used in Tables 3, 4, 5, 6, and 10, the following notations are used to indicate modified nucleotides, targeting groups, and linking groups:
A=adenosine-3'-phosphate
C=cytidine-3'-phosphate
G=guanosine-3'-phosphate
U=uridine-3'-phosphate
I=inosine-3'-phosphate
a=2'-O-methyladenosine-3'-phosphate
as =2'-O-methyladenosine-3'-phosphorothioate
c=2'-O-methylcytidine-3'-phosphate
cs=2'-O-methylcytidine-3'-phosphorothioate
g=2'-O-methylguanosine-3'-phosphate
gs=2'-O-methylguanosine-3'-phosphorothioate
i=2'-O-methylinosine-3'-phosphate
is=2'-O-methylinosine-3'-phosphorothioate
t=2'-O-methyl-5-methyluridine-3'-phosphate
ts=2'-O-methyl-5-methyluridine-3'-phosphorothioate
u=2'-O-methyluridine-3'-phosphate
us=2'-O-methyluridine-3'-phosphorothioate
Af=2'-fluoroadenosine-3'-phosphate
Afs=2'-fluoroadenosine-3'-phosporothioate Cf=2'-fluorocytidine-3'-phosphate
Cfs=2'-fluorocytidine-3'-phosphorothioate
Gf=2'-fluoroguanosine-3'-phosphate
Gfs=2'-fluoroguanosine-3'-phosphorothioate
Tf=2'-fluoro-5'-methyluridine-3'-phosphate
Tfs=2'-fluoro-5'-methyluridine-3'-phosphorothioate
Uf=2'-fluorouridine-3'-phosphate
Ufs=2'-fluorouridine-3'-phosphorothioate
dT=2'-deoxythymidine-3'-phosphate
dT=2'-deoxythymidine-3'-phosphorothioate
dU=2'-deoxyuridine-3'-phosphate
dUs=2'-deoxyuridine-3'-phosphorothioate
dA=2'-deoxyadenosine-3'-phosphate
dAs=2'-deoxyadenosine-3'-phosphorothioate
dG=2'-deoxyguanosine-3'-phosphate
dGs=2'-deoxyguanosine-3'-phosphorothioate
dC=2'-deoxycytidine-3'-phosphate
dCs=2'-deoxycytidine-3'-phosphorothioate
$A_{UNA}$=2',3'-seco-adenosine-3'-phosphate
$A_{UNA}s$=2',3'-seco-adenosine-3'-phosphorothioate
$C_{UNA}$=2',3'-seco-cytidine-3'-phosphate
$C_{UNA}s$=2',3'-seco-cytidine-3'-phosphorothioate
$G_{UNA}$=2',3'-seco-guanosine-3'-phosphate
$G_{UNA}s$=2',3'-seco-guanosine-3'-phosphorothioate
$U_{UNA}$=2',3'-seco-uridine-3'-phosphate
$U_{UNA}s$=2',3'-seco-uridine-3'-phosphorothioate
a_2N=2'-O-methyl-2-aminoadenosine-3'-phosphate, see Table 10
a_2Ns=2'-O-methyl-2-aminoadenosine-3'-phosphorothioate, see Table 10
(invAb)=inverted abasic deoxyribonucleotide-5'-phosphate, see Table 10
(invAb)s=inverted abasic deoxyribonucleotide-5'-phosphorothioate, see Table 10
s=phosphorothioate linkage
ss=phosphorodithioate linkage
p=terminal phosphate (as synthesized)
vpu=vinyl phosphonate 2'-O-methyluridine-3'-phosphate
cPrpa=5'-cyclopropyl phosphonate-2'-O-methyladenosine-3'-phosphate (see Table 10)
cPrpas=5'-cyclopropyl phosphonate-2'-O-methyladenosine-3'-phosphorothioate (see Table 10)
cPrpu=5'-cyclopropyl phosphonate-2'-O-methyluridine-3'-phosphate (see Table 10)
cPrpus=5'-cyclopropyl phosphonate-2'-O-methyluridine-3'-phosphorothioate (see Table 10)
(NH2-C6)=see Table 10
(NH-C6)=see Table 10
(NH-C6)s=see Table 10
(L20)=see Table 10
LP293=see Table 10
LP310=see Table 10
LP429=see Table 10
LP462=see Table 10
LP183=see Table 10
L-1026=see Table 10
uC16=see Table 10
[CP-1113]=Fabs were capped according to the procedure in Example 1E; (see also Table 10 for structure)
Fab0070=see Antigen Binding Proteins, infra As the person of ordinary skill in the art would readily understand, unless otherwise indicated by the sequence (such as, for example, by a phosphorothioate linkage "s"), when present in an oligonucleotide, the nucleotide monomers are mutually linked by 5'-3'-phosphodiester bonds. As the person of ordinary skill in the art would clearly understand, the inclusion of a phosphorothioate linkage as shown in the modified nucleotide sequences disclosed herein replaces the phosphodiester linkage typically present in oligonucleotides. Further, the person of ordinary skill in the art would readily understand that the terminal nucleotide at the 3' end of a given oligonucleotide sequence would typically have a hydroxyl (—OH) group at the respective 3' position of the given monomer instead of a phosphate moiety ex vivo. Additionally, for the embodiments disclosed herein, when viewing the respective strand 5'→3', the inverted abasic residues are inserted such that the 3' position of the deoxyribose is linked at the 3' end of the preceding monomer on the respective strand (see, e.g., Table 10). Moreover, as the person of ordinary skill would readily understand and appreciate, while the phosphorothioate chemical structures depicted herein typically show the anion on the sulfur atom, the inventions disclosed herein encompass all phosphorothioate tautomers (e.g., where the sulfur atom has a double-bond and the anion is on an oxygen atom). Unless expressly indicated otherwise herein, such understandings of the person of ordinary skill in the art are used when describing the MAPT RNAi agents and compositions of MAPT RNAi agents disclosed herein.

Certain examples of antigen binding proteins and linking groups used with the MAPT RNAi agents disclosed herein are included in the chemical structures provided below in Table 10. Each sense strand and/or antisense strand can have any antigen binding protein or linking group listed herein, as well as other targeting groups, antigen binding proteins, linking groups, conjugated to the 5' and/or 3' end of the sequence.

Certain examples of PK/PD modulators and linking groups used with the MAPT RNAi agents disclosed herein are included in the chemical structures provided below in Table 10. Each sense strand and/or antisense strand can have any PK/PD modulators or linking groups listed herein, as well as other targeting groups, PK/PD modulators, linking groups, conjugated to the 5' and/or 3' end of the sequence.

TABLE 3

MAPT RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
| --- | --- | --- | --- | --- |
| CA004894 | cPrpusAfsgucuAfccauGfuUfgAfugcussg | 545 | UAGUCUACCAUGUUGAUGCUG | 741 |
| CA004895 | cPrpusAfsgucuAfcuauGfuCfgAfugcussg | 546 | UAGUCUACUAUGUCGAUGCUG | 742 |
| CA004897 | cPrpusAfsgucuAfC$_{UNA}$cauGfuCfgAfugcussg | 547 | UAGUCUACCAUGUCGAUGCUG | 743 |
| CA004898 | cPrpusAfsgucU$_{UNA}$AfccauGfuCfgAfugcussg | 548 | UAGUCUACCAUGUCGAUGCUG | 743 |

TABLE 3-continued

MAPT RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
| --- | --- | --- | --- | --- |
| CA004899 | cPrpusAfsgucudAccauGfuCfgAfugcussg | 549 | UAGUCUACCAUGUCGAUGCUG | 743 |
| CA005104 | vpusAfsccdAudAcgagcuUfgGfgucacsgsu | 550 | UACCAUACGAGCUUGGGUCACGU | 744 |
| CA005435 | cPrpusAfsgucU$_{UNA}$AfccauGfuUfgAfugcussg | 551 | UAGUCUACCAUGUUGAUGCUG | 741 |
| CA005471 | cPrpusAfsgucuAfccauGfudTgAfugcussg | 552 | UAGUCUACCAUGUTGAUGCUG | 745 |
| CA006181 | cPrpusUfsgcuU$_{UNA}$UfuacuGfaCfcAfugcgssa | 553 | UUGCUUUACUGACCAUGCGA | 746 |
| CA914417 | cPrpusUfsasCfgUfcccagCfgUfgAfuCfuusc | 554 | UUACGUCCCAGCGUGAUCUUC | 747 |
| CA914420 | cPrpusUfsgsAfcCfagcagCfuUfcGfuCfuusc | 555 | UUGACCAGCAGCUUCGUCUUC | 748 |
| CA914422 | cPrpusUfsasCfuGfaccauGfcGfaGfcUfugsg | 556 | UUACUGACCAUGCGAGCUUGG | 749 |
| CA914424 | cPrpusUfsusGfcUfuuuacUfgAfcCfaUfgcsg | 557 | UUUGCUUUACUGACCAUGCG | 750 |
| CA914426 | cPrpusCfsgsUfcUfuugcuUfuUfaCfuGfacsc | 558 | UCGUCUUUGCUUUACUGACC | 751 |
| CA914428 | cPrpusUfsusUfuGfucaucGfcUfuCfcAfgusc | 559 | UUUUUGUCAUCGCUUCCAGUC | 752 |
| CA914430 | cPrpusCfsusUfuUfuugucAfuCfgCfuUfccsa | 560 | UCUUUUUGUCAUCGCUUCCA | 753 |
| CA914432 | cPrpusGfsusUfuUfugcugGfaAfuCfcUfggsu | 561 | UGUUUUGCUGGAAUCCUGGU | 754 |
| CA914434 | cPrpusGfsasUfuUfuggagGfuUfcAfcCfagsa | 562 | UGAUUUGGAGGUUCACCAGA | 755 |
| CA914436 | cPrpusCfscsUfgAfuuuugGfaGfgUfuCfacsc | 563 | UCCUGAUUUGGAGGUUCACC | 756 |
| CA914438 | cPrpusUfsgsCfgAfuccccUfgAfuUfuUfggsa | 564 | UUGCGAUCCCCUGAUUUGGA | 757 |
| CA914440 | cPrpasAfscsUfgGfuuuguAfgAfcUfaUfuusg | 565 | AACUGGUUUGUAGACUAUUUG | 758 |
| CA914443 | cPrpusCfsasAfcUfgguuuGfuAfgAfcUfausu | 566 | UCAACUGGUUUGUAGACUAUU | 759 |
| CA914445 | cPrpusUfscsAfaCfugguuUfgUfaGfaCfuasu | 567 | UUCAACUGGUUUGUAGACUAU | 760 |
| CA914447 | cPrpasGfsgsUfcAfacuggUfuUfgUfaGfacsu | 568 | AGGUCAACUGGUUUGUAGACU | 761 |
| CA914449 | cPrpusCfsusUfgCfucaggUfcAfaCfuGfgusu | 569 | UCUUGCUCAGGUCAACUGGUU | 762 |
| CA914451 | cPrpusAfsasUfgAfgccacAfcUfuGfgAfggsu | 570 | UAAUGAGCCACACUUGGAGGU | 763 |
| CA914453 | cPrpusCfsusAfaUfgagccAfcAfcUfuGfgasg | 571 | UCUAAUGAGCCACACUUGGAG | 764 |
| CA914455 | cPrpusCfscsUfaAfugagcCfaCfaCfuUfggsa | 572 | UCCUAAUGAGCCACACUUGGA | 765 |
| CA914457 | cPrpusGfscsCfuAfaugagCfcAfcAfcUfugsg | 573 | UGCCUAAUGAGCCACACUUGG | 766 |
| CA914459 | cPrpusGfsasUfgUfugccuAfaUfgAfgCfcasc | 574 | UGAUGUUGCCUAAUGAGCCAC | 767 |
| CA914461 | cPrpusUfsasUfgAfuggauGfuUfgCfcUfaasu | 575 | UUAUGAUGGAUGUUGCCUAAU | 768 |
| CA914463 | cPrpusUfsusAfuGfauggaUfgUfuGfcCfuasc | 576 | UUUAUGAUGGAUGUUGCCUAC | 769 |
| CA914465 | cPrpusGfsusUfuAfugaugGfaUfgUfuGfccsu | 577 | UGUUUAUGAUGGAUGUUGCCU | 770 |
| CA914467 | cPrpasGfsasUfuUfuacuuCfcAfcCfuGfgcsc | 578 | AGAUUUACUUCCACCUGGCC | 771 |
| CA914469 | cPrpasGfscsUfuGfugggUfuUfcAfuCfuusc | 579 | AGCUUGUGGGUUUCAAUCUUC | 772 |
| CA914471 | cPrpusCfsasGfcUfuguggGfuUfuCfaAfucsu | 580 | UCAGCUUGUGGGUUUCAAUCU | 773 |
| CA914473 | cPrpusUfscsAfgCfuuguggGfuUfuCfaAfausc | 581 | UUCAGCUUGUGGGUUUCAAUC | 774 |
| CA914475 | cPrpusGfsusCfuGfucuugGfcUfuUfgGfcgsu | 582 | UGUCUGUCUUGGCUUUGGCGU | 775 |
| CA914477 | cPrpusAfsgsUfcUfaccauGfuCfgAfuGfcusg | 583 | UAGUCUACCAUGUCGAUGCUG | 743 |
| CA915404 | cPrpusGfsccuaAfugagCfcAfcAfcuugsg | 584 | UGCCUAAUGAGCCACACUUGG | 766 |

TABLE 3-continued

MAPT RNAi Agent Antisense Strand Sequences

| AS Strand ID | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| CA915423 | cPrpusAfsgsuCfuaccauGfuCfgAfugcusg | 585 | UAGUCUACCAUGUCGAUGCUG | 743 |
| CA915424 | cPrpusAfsgsucuAfccauGfuCfgAfugcusg | 586 | UAGUCUACCAUGUCGAUGCUG | 743 |
| CA915425 | cPrpusAfsgsucuacCfauGfuCfgAfugcusg | 587 | UAGUCUACCAUGUCGAUGCUG | 743 |
| CA915426 | cPrpusAfsgucuAfccauGfuCfgAfugcusg | 588 | UAGUCUACCAUGUCGAUGCUG | 743 |
| CA915430 | cPrpusAfsgsucuAfccauGfuCfgaugcusg | 589 | UAGUCUACCAUGUCGAUGCUG | 743 |
| CA915431 | cPrpusAfsgsucuacCfauguCfgaugcusg | 590 | UAGUCUACCAUGUCGAUGCUG | 743 |
| CA915432 | cPrpusAfsgsucuAfccauguCfgaugcUfsg | 591 | UAGUCUACCAUGUCGAUGCUG | 743 |
| CA915905 | cPrpusAfsgucuAfccauGfuCfgAfugcussg | 592 | UAGUCUACCAUGUCGAUGCUG | 743 |
| CA916146 | cPrpusAfsgucuAfccauGfuCfgAfugcsusg | 593 | UAGUCUACCAUGUCGAUGCUG | 743 |
| CA916147 | cPrpusAfsgucuA$_{UNA}$ccauGfuCfgAfugcusg | 594 | UAGUCUACCAUGUCGAUGCUG | 743 |
| CA916148 | cPrpusAfsgucudAccauGfuCfgdAugcusg | 595 | UAGUCUACCAUGUCGAUGCUG | 743 |
| CA916149 | cPrpusAfsgucudAccaudGuCfgdAugcusg | 596 | UAGUCUACCAUGUCGAUGCUG | 743 |

TABLE 4

MAPT RNAi Agent Sense Strand Sequences (Shown Without Linkers, Conjugates, or Capping Moieties)

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS004896-NL | cagcaucgAfuAfUfgguagacua | 597 | CAGCAUCGAUAUGGUAGACUA | 776 |
| CS005096-NL | cagcaucgAfcAfUfgguagacua | 598 | CAGCAUCGACAUGGUAGACUA | 777 |
| CS005097-NL | cagcaucgAfcAfUfgguagacua | 599 | CAGCAUCGACAUGGUAGACUA | 777 |
| CS005098-NL | cagcaucgAfcAfUfgguagacua | 600 | CAGCAUCGACAUGGUAGACUA | 777 |
| CS005099-NL | cagcauC16cgAfcAfUfgguagacua | 601 | CAGCAUCGACAUGGUAGACUA | 777 |
| CS005103-NL | gsusgaccC16caAfGfCfucguauggsusa | 602 | GUGACCCAAGCUCGUAUGGUA | 778 |
| CS005303-NL | ccaaguGfuGfgCfcauuaggua | 603 | CCAAGUGUGGCUCAUUAGGUA | 779 |
| CS005470-NL | cagcaucaAfcAfUfgguagacua | 604 | CAGCAUCAACAUGGUAGACUA | 780 |
| CS006178-NL | ucgcauggUfcAfguaaaagcaa | 605 | UCGCAUGGUCAGUAAAAGCAA | 781 |
| CS008817-NL | cagcaucgAfcAfUfgguagacua | 606 | CAGCAUCGACAUGGUAGACUA | 777 |
| CS011528-NL | cagcaucgAfcAfUfgguagacua | 607 | CAGCAUCGACAUGGUAGACUA | 777 |
| CS914416-NL | gaagaucaCfGfCfugggaciuaa | 608 | GAAGAUCACGCUGGGACIUAA | 782 |
| CS914418-NL | gaagaucaCfGfCfugggauguaa | 609 | GAAGAUCACGCUGGGAUGUAA | 783 |
| CS914419-NL | gaagacgaAfGfCfugcuigucaa | 610 | GAAGACGAAGCUGCUIGUCAA | 784 |
| CS914421-NL | ccaagcucGfCfAfuggucaguaa | 611 | CCAAGCUCGCAUGGUCAGUAA | 785 |
| CS914423-NL | cgcaugguCfAfGfuaaaagcaaa | 612 | CGCAUGGUCAGUAAAAGCAAA | 786 |
| CS914425-NL | ggucaguaAfAfAfgcaaagacia | 613 | GGUCAGUAAAAGCAAAGACIA | 787 |
| CS914427-NL | gacuggaaGfCfGfaugacaaaaa | 614 | GACUGGAAGCGAUGACAAAAA | 788 |

TABLE 4-continued

MAPT RNAi Agent Sense Strand Sequences (Shown Without Linkers, Conjugates, or Capping Moieties)

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS914429-NL | uggaagcgAfUfGfacaaaaaga | 615 | UGGAAGCGAUGACAAAAAGA | 789 |
| CS914431-NL | accaggauUfCfCfagcaaaaaca | 616 | ACCAGGAUUCCAGCAAAAACA | 790 |
| CS914433-NL | ucuggugaAfCfCfuccaaaauca | 617 | UCUGGUGAACCUCCAAAAUCA | 791 |
| CS914435-NL | ggugaaccUfCfCfaaaaucaiga | 618 | GGUGAACCUCCAAAAUCAIGA | 792 |
| CS914437-NL | ucca_2NaaauCfAfGfgggaucicaa | 619 | UCC(A$^{2N}$)AAAUCAGGGGAUCICAA | 793 |
| CS914439-NL | caa_2NauaguCfUfAfcaaaccaguu | 620 | CA(A$^{2N}$)AUAGUCUACAAACCAGUU | 794 |
| CS914441-NL | caa_2NauaguCfUfAfcaaacuaguu | 621 | CA(A$^{2N}$)AUAGUCUACAAACUAGUU | 795 |
| CS914442-NL | a_2NauagucuAfCfAfaaccaiuuga | 622 | (A$^{2N}$)AUAGUCUACAAACCAIUUGA | 796 |
| CS914444-NL | a_2NuagucuaCfAfAfaccaguugaa | 623 | (A$^{2N}$)UAGUCUACAAACCAGUUGAA | 797 |
| CS914446-NL | agucuacaAfAfCfcaguuiaccu | 624 | AGUCUACAAACCAGUUIACCU | 798 |
| CS914448-NL | aaccaguuGfAfCfcugaicaaga | 625 | AACCAGUUGACCUGAICAAGA | 799 |
| CS914450-NL | accuccaaGfUfGfuggcucauua | 626 | ACCUCCAAGUGUGGCUCAUUA | 800 |
| CS914452-NL | cuccaaguGfUfGfgcucauuaga | 627 | CUCCAAGUGUGGCUCAUUAGA | 801 |
| CS914454-NL | uccaagugUfGfGfcucauuagga | 628 | UCCAAGUGUGGCUCAUUAGGA | 802 |
| CS914456-NL | ccaaguguGfGfCfucauuagica | 629 | CCAAGUGUGGCUCAUUAGICA | 803 |
| CS914458-NL | guggcucaUfUfAfggcaacauca | 630 | GUGGCUCAUUAGGCAACAUCA | 804 |
| CS914460-NL | a_2NuuaggcaAfCfAfuccaucauaa | 631 | (A$^{2N}$)UUAGGCAACAUCCAUCAUAA | 805 |
| CS914462-NL | guaggcaaCfAfUfccaucauaaa | 632 | GUAGGCAACAUCCAUCAUAAA | 806 |
| CS914464-NL | aggcaacaUfCfCfaucauaaaca | 633 | AGGCAACAUCCAUCAUAAACA | 807 |
| CS914466-NL | ggccagguGfGfAfaguaaaaucu | 634 | GGCCAGGUGGAAGUAAAAUCU | 808 |
| CS914468-NL | ga_2NagauugAfAfAfcccacaaicu | 635 | G(A$^{2N}$)AGAUUGAAACCCACAAICU | 809 |
| CS914470-NL | a_2NgauugaaAfCfCfcacaaicuga | 636 | (A$^{2N}$)GAUUGAAACCCACAAICUGA | 810 |
| CS914472-NL | ga_2NuugaaaCfCfCfacaaicugaa | 637 | G(A$^{2N}$)UUGAAACCCACAAICUGAA | 811 |
| CS914474-NL | acgccaaaGfCfCfaagacaiaca | 638 | ACGCCAAAGCCAAGACAIACA | 812 |
| CS914476-NL | cagcaucgAfCfAfugguagacua | 639 | CAGCAUCGACAUGGUAGACUA | 777 |
| CS915422-NL | cagcaucgAfCfAfugguagacua | 640 | CAGCAUCGACAUGGUAGACUA | 777 |
| CS915427-NL | cagcaucgAfcAfugguagacua | 641 | CAGCAUCGACAUGGUAGACUA | 777 |

TABLE 4-continued

MAPT RNAi Agent Sense Strand Sequences (Shown Without Linkers, Conjugates, or Capping Moieties)

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS915428-NL | cagcaucCfgAfcAfugguagacua | 642 | CAGCAUCGACAUGGUAGACUA | 777 |
| CS915429-NL | cagcaucgAfcAfUfgguagacua | 643 | CAGCAUCGACAUGGUAGACUA | 777 |
| CS916150-NL | cagcaucgAfcAfdTgguagacua | 644 | CAGCAUCGACATGGUAGACUA | 813 |

($A^{2N}$) = 2-aminoadenine nucleotide; I = hypoxanthine (inosine) nucleotide

TABLE 5

MAPT RNAi Agent Sense Strand Sequences (Shown without antigen binding protein conjugate and with terminal caps (see Table 10 for structure information.))

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS004896-C | (invAb)scagcaucgAfuAfUfgguagacuas(invAb) | 645 | CAGCAUCGAUAUGGUAGACUA | 776 |
| CS005096-C | (invAb)scagcaucgAfcAfUfgguagacuas(invAb) | 646 | CAGCAUCGACAUGGUAGACUA | 777 |
| CS005097-C | (invAb)scagcaucgAfcAfUfgguagacuas(invAb) | 647 | CAGCAUCGACAUGGUAGACUA | 777 |
| CS005098-C | (invAb)scagcaucgAfcAfUfgguagacuas(invAb) | 648 | CAGCAUCGACAUGGUAGACUA | 777 |
| CS005099-C | (invAb)scagcauC16cgAfcAfUfgguagacuas(invAb) | 649 | CAGCAUCGACAUGGUAGACUA | 777 |
| CS005103-C | gsusgaccC16caAfGfCfucguauggsusa | 650 | GUGACCCAAGCUCGUAUGGUA | 778 |
| CS005303-C | (invAb)sccaaguGfuGfgCfucauuagguas(invAb) | 651 | CCAAGUGUGGCUCAUUAGGUA | 779 |
| CS005470-C | (invAb)scagcaucaAfcAfUfgguagacuas(invAb) | 652 | CAGCAUCAACAUGGUAGACUA | 780 |
| CS006178-C | (invAb)sucgcauggUfcAfguaaaagcaas(invAb) | 653 | UCGCAUGGUCAGUAAAAGCAA | 781 |
| CS008817-C | (invAb)scagcaucgAfcAfUfgguagacuas(invAb) | 654 | CAGCAUCGACAUGGUAGACUA | 777 |
| CS011528-C | (invAb)scagcaucgAfcAfUfgguagacuas(invAb) | 655 | CAGCAUCGACAUGGUAGACUA | 777 |
| CS914416-C | (invAb)sgaagaucaCfGfCfugggaciuaas(invAb) | 656 | GAAGAUCACGCUGGGACIUAA | 782 |
| CS914418-C | (invAb)sgaagaucaCfGfCfugggauguaas(invAb) | 657 | GAAGAUCACGCUGGGAUGUAA | 783 |
| CS914419-C | (invAb)sgaagacgaAfGfCfugcuigucaas(invAb) | 658 | GAAGACGAAGCUGCUIGUCAA | 784 |
| CS914421-C | (invAb)sccaagcucGfCfAfuggucaguaas(invAb) | 659 | CCAAGCUCGCAUGGUCAGUAA | 785 |
| CS914423-C | (invAb)sgcaugguCfAfGfuaaaagcaaas(invAb) | 660 | CGCAUGGUCAGUAAAAGCAAA | 786 |
| CS914425-C | (invAb)sggucaguaAfAfAfgcaaagacias(invAb) | 661 | GGUCAGUAAAAGCAAAGACIA | 787 |
| CS914427-C | (invAb)sgacuggaaGfCfGfaugacaaaaas(invAb) | 662 | GACUGGAAGCGAUGACAAAAA | 788 |
| CS914429-C | (invAb)suggaagcgAfUfGfacaaaaagas(invAb) | 663 | UGGAAGCGAUGACAAAAAGA | 789 |
| CS914431-C | (invAb)saccaggauUfCfCfagcaaaaacas(invAb) | 664 | ACCAGGAUUCCAGCAAAAACA | 790 |
| CS914433-C | (invAb)sucggugaAfCfCfuccaaaaucas(invAb) | 665 | UCGGUGAACCUCCAAAAUCA | 791 |
| CS914435-C | (invAb)sggugaaccUfCfCfaaaaucaigas(invAb) | 666 | GGUGAACCUCCAAAAUCAIGA | 792 |
| CS914437-C | (invAb)succa_2NaaauCfAfGfgggaucicaas(invAb) | 667 | UCC($A^{2N}$)AAAUCAGGGGAUCICAA | 793 |
| CS914439-C | (invAb)scaa_2NauaguCfUfAfcaaaccaguus(invAb) | 668 | CA($A^{2N}$)AUAGUCUACAAACCAGUU | 794 |
| CS914441-C | (invAb)scaa_2NauaguCfUfAfcaaacuaguus(invAb) | 669 | CA($A^{2N}$)AUAGUCUACAAACUAGUU | 795 |
| CS914442-C | (invAb)sa_2NauagucuAfCfAfaaccaiuugas(invAb) | 670 | ($A^{2N}$)AUAGUCUACAAACCAIUUGA | 796 |

TABLE 5-continued

MAPT RNAi Agent Sense Strand Sequences (Shown without antigen binding protein conjugate and with terminal caps (see Table 10 for structure information.))

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS914444-C | (invAb)sa_2NuagucuaCfAfAfaccaguugaas(invAb) | 671 | (A$^{2N}$)UAGUCUACAAACCAGUUGAA | 797 |
| CS914446-C | (invAb)sagucuacaAfAfCfcaguuiaccus(invAb) | 672 | AGUCUACAAACCAGUUIACCU | 798 |
| CS914448-C | (invAb)saaccaguuGfAfCfcugaicaagas(invAb) | 673 | AACCAGUUGACCUGAICAAGA | 799 |
| CS914450-C | (invAb)saccuccaaGfUfGfuggcucauuas(invAb) | 674 | ACCUCCAAGUGUGGCUCAUUA | 800 |
| CS914452-C | (invAb)scuccaaguGfUfGfgcucauuagas(invAb) | 675 | CUCCAAGUGUGGCUCAUUAGA | 801 |
| CS914454-C | (invAb)succaagugUfGfGfcucauuaggas(invAb) | 676 | UCCAAGUGUGGCUCAUUAGGA | 802 |
| CS914456-C | (invAb)sccaagugUfGfGfCfucauuagicas(invAb) | 677 | CCAAGUGUGGCUCAUUAGICA | 803 |
| CS914458-C | (invAb)sguggcucaUfUfAfggcaacaucas(invAb) | 678 | GUGGCUCAUUAGGCAACAUCA | 804 |
| CS914460-C | (invAb)sa_2NuuaggcaAfCfAfuccaucauaas(invAb) | 679 | (A$^{2N}$)UUAGGCAACAUCCAUCAUAA | 805 |
| CS914462-C | (invAb)sguaggcaaCfAfUfccaucauaaas(invAb) | 680 | GUAGGCAACAUCCAUCAUAAA | 806 |
| CS914464-C | (invAb)saggcaacaUfCfCfaucauaaacas(invAb) | 681 | AGGCAACAUCCAUCAUAAACA | 807 |
| CS914466-C | (invAb)sggccagguGfGfAfaguaaaaucus(invAb) | 682 | GGCCAGGUGGAAGUAAAAUCU | 808 |
| CS914468-C | (invAb)sga_2NagauugAfAfAfcccacaaicus(invAb) | 683 | G(A$^{2N}$)AGAUUGAAACCCACAAICU | 809 |
| CS914470-C | (invAb)sa_2NgauugaaAfCfCfcacaaicugas(invAb) | 684 | (A$^{2N}$)GAUUGAAACCCACAAICUGA | 810 |
| CS914472-C | (invAb)sga_2NuugaaaCfCfCfacaaicugaas(invAb) | 685 | G(A$^{2N}$)UUGAAACCCACAAICUGAA | 811 |
| CS914474-C | (invAb)sacgccaaaGfCfCfaagacaiacas(invAb) | 686 | ACGCCAAAGCCAAGACAIACA | 812 |
| CS914476-C | (invAb)scagcaucgAfCfAfugguagacuas(invAb) | 687 | CAGCAUCGACAUGGUAGACUA | 777 |
| CS915422-C | (invAb)scagcaucgAfCfAfugguagacuas(invAb) | 688 | CAGCAUCGACAUGGUAGACUA | 777 |
| CS915427-C | (invAb)scagcaucgAfcAfugguagacuas(invAb) | 689 | CAGCAUCGACAUGGUAGACUA | 777 |
| CS915428-C | (invAb)scagcauCfgAfcAfugguagacuas(invAb) | 690 | CAGCAUCGACAUGGUAGACUA | 777 |
| CS915429-C | (invAb)scagcaucgAfcAfUfgguagacuas(invAb) | 691 | CAGCAUCGACAUGGUAGACUA | 777 |
| CS916150-C | (invAb)scagcaucgAfcAfdTgguagacuas(invAb) | 692 | CAGCAUCGACATGGUAGACUA | 813 |

(A$^{2N}$) = 2-aminoadenine nucleotide; I = hypoxanthine (inosine) nucleotide

TABLE 6

MAPT Agent Sense Strand Sequences (shown with lipid or antigen binding moiety). The structures of the lipid and antigen binding moieties are shown in Table 10.

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS004896 | LP293-(NH-C6)s(invAb)scagcaucgAfuAfUfgguagacuas(invAb) | 693 | CAGCAUCGAUAUGGUAGACUA | 776 |
| CS005096 | LP310-(NH-C6)s(invAb)scagcaucgAfcAfUfgguagacuas(invAb) | 694 | CAGCAUCGACAUGGUAGACUA | 777 |
| CS005097 | LP429-(NH-C6)s(invAb)scagcaucgAfcAfUfgguagacuas(invAb) | 695 | CAGCAUCGACAUGGUAGACUA | 777 |

TABLE 6-continued

MAPT Agent Sense Strand Sequences (shown with lipid or antigen binding moiety). The structures of the lipid and antigen binding moieties are shown in Table 10.

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS005098 | LP462-(NH-C6)s(invAb)scagcaucgAfcAfUfgguagacuas(invAb) | 696 | CAGCAUCGACAUGGUAGACUA | 777 |
| CS005099 | (invAb)scagcauC16cgAfcAfUfgguagacuas(invAb) | 697 | CAGCAUCGACAUGGUAGACUA | 777 |
| CS005103 | gsusgaccC16caAfGfCfucguauggsusa | 698 | GUGACCCAAGCUCGUAUGGUA | 778 |
| CS005303 | LP293-(NH-C6)s(invAb)sccaaguGfuGfgCfucauuaggus(invAb) | 699 | CCAAGUGUGGCUCAUUAGGUA | 779 |
| CS005470 | LP293-(NH-C6)s(invAb)scagcaucaAfcAfUfgguagacuas(invAb) | 700 | CAGCAUCAACAUGGUAGACUA | 780 |
| CS006178 | LP293-(NH-C6)s(invAb)sucgcauggUfcAfguaaaagcaas(invAb) | 701 | UCGCAUGGUCAGUAAAAGCAA | 781 |
| CS008817 | Fab0070-[CP-1113]L20-(NH-C6)s(invAb)scagcaucgAfcAfUfgguagacuas(invAb) | 702 | CAGCAUCGACAUGGUAGACUA | 777 |
| CS011528 | Fab0070-L-1026-(NH-C6)s(invAb)scagcaucgAfcAfUfgguagacuas(invAb) | 703 | CAGCAUCGACAUGGUAGACUA | 777 |
| CS914416 | LP183-(NH-C6)s(invAb)sgaagaucaCfGfCfugggaciuaas(invAb) | 704 | GAAGAUCACGCUGGGACIUAA | 782 |
| CS914418 | LP183-(NH-C6)s(invAb)sgaagaucaCfGfCfugggauguaas(invAb) | 705 | GAAGAUCACGCUGGGAUGUAA | 783 |
| CS914419 | LP183-(NH-C6)s(invAb)sgaagacgaAfGfCfugcuigucaas(invAb) | 706 | GAAGACGAAGCUGCUIGUCAA | 784 |
| CS914421 | LP183-(NH-C6)s(invAb)sccaagcucGfCfAfuggucaguaas(invAb) | 707 | CCAAGCUCGCAUGGUCAGUAA | 785 |
| CS914423 | LP183-(NH-C6)s(invAb)scgcaugguCfAfGfuaaaagcaaas(invAb) | 708 | CGCAUGGUCAGUAAAAGCAAA | 786 |
| CS914425 | LP183-(NH-C6)s(invAb)sggucaguaAfAfAfgcaaagacias(invAb) | 709 | GGUCAGUAAAAGCAAAGACIA | 787 |
| CS914427 | LP183-(NH-C6)s(invAb)sgacuggaaGfCfGfaugacaaaaas(invAb) | 710 | GACUGGAAGCGAUGACAAAAA | 788 |
| CS914429 | LP183-(NH-C6)s(invAb)suggaagcgAfUfGfacaaaaagas(invAb) | 711 | UGGAAGCGAUGACAAAAAGA | 789 |
| CS914431 | LP183-(NH-C6)s(invAb)saccaggauUfCfCfagcaaaaacas(invAb) | 712 | ACCAGGAUUCCAGCAAAAACA | 790 |
| CS914433 | LP183-(NH-C6)s(invAb)sucugguga AfCfCfuccaaaaucas(invAb) | 713 | UCUGGUGAACCUCCAAAAUCA | 791 |
| CS914435 | LP183-(NH-C6)s(invAb)sggugaaccUfCfCfaaaaucaigas(invAb) | 714 | GGUGAACCUCCAAAAUCAIGA | 792 |
| CS914437 | LP183-(NH-C6)s(invAb)succa_2NaaauCfAfGfgggaucIcaas(invAb) | 715 | UCC($A^{2N}$)AAAUCAGGGGAUCICAA | 793 |
| CS914439 | LP183-(NH-C6)s(invAb)scaa_2NauaguCfUfAfcaaaccaguus(invAb) | 716 | CA($A^{2N}$)AUAGUCUACAAACCAGUU | 794 |
| CS914441 | LP183-(NH-C6)s(invAb)scaa_2NauaguCfUfAfcaaacuaguus(invAb) | 717 | CA($A^{2N}$)AUAGUCUACAAACUAGUU | 795 |
| CS914442 | LP183-(NH-C6)s(invAb)sa_2NauagucuAfCfAfaaccaiuugas(invAb) | 718 | ($A^{2N}$)AUAGUCUACAAACCAIUUGA | 796 |
| CS914444 | LP183-(NH-C6)s(invAb)sa_2NuagucuaCfAfAfaccaguugaas(invAb) | 719 | ($A^{2N}$)UAGUCUACAAACCAGUUGAA | 797 |

TABLE 6-continued

MAPT Agent Sense Strand Sequences (shown with lipid or antigen binding moiety). The structures of the lipid and antigen binding moieties are shown in Table 10.

| Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS914446 | LP183-(NH-C6)s(invAb)sagucuacaAfAfCfcaguuiaccus(invAb) | 720 | AGUCUACAAACCAGUUIACCU | 798 |
| CS914448 | LP183-(NH-C6)s(invAb)saaccaguuGfAfCfcugaicaagas(invAb) | 721 | AACCAGUUGACCUGAICAAGA | 799 |
| CS914450 | LP183-(NH-C6)s(invAb)saccuccaaGfUfGfuggcucauuas(invAb) | 722 | ACCUCCAAGUGUGGCUCAUUA | 800 |
| CS914452 | LP183-(NH-C6)s(invAb)scuccaaguGfUfGfgcucauuagas(invAb) | 723 | CUCCAAGUGUGGCUCAUUAGA | 801 |
| CS914454 | LP183-(NH-C6)s(invAb)succaagugUfGfGfcucauuaggas(invAb) | 724 | UCCAAGUGUGGCUCAUUAGGA | 802 |
| CS914456 | LP183-(NH-C6)s(invAb)sccaaguguGfGfCfucauuagicas(invAb) | 725 | CCAAGUGUGGCUCAUUAGICA | 803 |
| CS914458 | LP183-(NH-C6)s(invAb)sguggcucaUfUfAfggcaacaucas(invAb) | 726 | GUGGCUCAUUAGGCAACAUCA | 804 |
| CS914460 | LP183-(NH-C6)s(invAb)sa_2NuuaggcaAfCfAfuccaucauaas(invAb) | 727 | (A$^{2N}$)UUAGGCAACAUCCAUCAUAA | 805 |
| CS914462 | LP183-(NH-C6)s(invAb)sguaggcaaCfAfUfccaucauaaas(invAb) | 728 | GUAGGCAACAUCCAUCAUAAA | 806 |
| CS914464 | LP183-(NH-C6)s(invAb)saggcaacaUfCfCfaucauaaacas(invAb) | 729 | AGGCAACAUCCAUCAUAAACA | 807 |
| CS914466 | LP183-(NH-C6)s(invAb)sggccagguGfGfAfaguaaaaucus(invAb) | 730 | GGCCAGGUGGAAGUAAAAUCU | 808 |
| CS914468 | LP183-(NH-C6)s(invAb)sga_2NagauugAfAfAfcccacaaicus(invAb) | 731 | G(A$^{2N}$)AGAUUGAAACCCACAAICU | 809 |
| CS914470 | LP183-(NH-C6)s(invAb)sa_2NgauugaaAfCfCfcacaaicugas(invAb) | 732 | (A$^{2N}$)GAUUGAAACCCACAAICUGA | 810 |
| CS914472 | LP183-(NH-C6)s(invAb)sga_2NuugaaaCfCfCfacaaicugaas(invAb) | 733 | GAUUGAAACCCACAAICUGAA | 811 |
| CS914474 | LP183-(NH-C6)s(invAb)sacgccaaaGfCfCfaagacaiacas(invAb) | 734 | ACGCCAAAGCCAAGACAIACA | 812 |
| CS914476 | LP183-(NH-C6)s(invAb)scagcaucgAfCfAfugguagacuas(invAb) | 735 | CAGCAUCGACAUGGUAGACUA | 777 |
| CS915422 | LP293-(NH-C6)s(invAb)scagcaucgAfCfAfugguagacuas(invAb) | 736 | CAGCAUCGACAUGGUAGACUA | 777 |
| CS915427 | LP293-(NH-C6)s(invAb)scagcaucgAfcAfugguagacuas(invAb) | 737 | CAGCAUCGACAUGGUAGACUA | 777 |
| CS915428 | LP293-(NH-C6)s(invAb)scagcauCfgAfcAfugguagacuas(invAb) | 738 | CAGCAUCGACAUGGUAGACUA | 777 |
| CS915429 | LP293-(NH-C6)s(invAb)scagcaucgAfcAfUfgguagacuas(invAb) | 739 | CAGCAUCGACAUGGUAGACUA | 777 |
| CS916150 | LP293-(NH-C6)s(invAb)scagcaucgAfcAfdTgguagacuas(invAb) | 740 | CAGCAUCGACATGGUAGACUA | 813 |

(A$^{2N}$) = 2-aminoadenine nucleotide; I = hypoxanthine (inosine) nucleotide

The MAPT RNAi agents disclosed herein are formed by annealing an antisense strand with a sense strand. A sense strand containing a sequence listed in Table 2, Table 4, Table 5, or Table 6, can be hybridized to any antisense strand containing a sequence listed in Table 2 or Table 3, provided the two sequences have a region of at least 85% complementarity over a contiguous 16, 17, 18, 19, 20, or 21 nucleotide sequence.

As shown in Table 6 above, certain of the example MAPT RNAi agent nucleotide sequences are shown to further include reactive linking groups at one or both of the 5' terminal end and the 3' terminal end of the sense strand. For example, many of the MAPT RNAi agent sense strand sequences shown in Table 6 above have a (NH-C6) linking group at the 5' end of the nucleotide sequence, which was synthesized first as a (NH2-C6) group and then conjugated to a PK/PD modulator or linker such as L-20 or L-1026 (see Example 1, below, for conjugation details). Other linking groups, such as a (6-SS-6) linking group or a (C6-SS-C6) linking group, may be present as well or alternatively in certain embodiments. Such reactive linking groups are positioned to facilitate the linking of targeting ligands, targeting groups, and/or antigen binding proteins to the MAPT RNAi agents disclosed herein. Linking or conjugation reactions are well known in the art and provide for formation of covalent linkages between two molecules or reactants. Suitable conjugation reactions for use in the scope of the inventions herein include, but are not limited to, amide coupling reaction, Michael addition reaction, hydrazone formation reaction, inverse-demand Diels-Alder cycloaddition reaction, oxime ligation, and Copper (I)-catalyzed or strain-promoted azide-alkyne cycloaddition reaction cycloaddition reaction.

In some embodiments, targeting ligands, can be synthesized as activated esters, such as tetrafluorophenyl (TFP) esters, which can be displaced by a reactive amino group (e.g., NH2-C6) to attach the targeting ligand to the MAPT RNAi agents disclosed herein. In some embodiments, targeting ligands are synthesized as azides, which can be conjugated to a propargyl or DBCO group, for example, via Copper (I)-catalyzed or strain-promoted azide-alkyne cycloaddition reaction.

Additionally, certain of the nucleotide sequences can be synthesized with a dT nucleotide at the 3' terminal end of the sense strand, followed by (3'→5') a linker (e.g., C6-SS-C6). The linker can, in some embodiments, facilitate the linkage to additional components, such as, for example, an antigen binding protein or one or more targeting ligands. As described herein, the disulfide bond of C6-SS-C6 is first reduced, removing the dT from the molecule, which can then facilitate the conjugation of the desired component. The terminal dT nucleotide therefore is not a part of the fully conjugated construct.

Additionally, certain of the nucleotide sequences can be synthesized with a dT nucleotide at the 3' terminal end of the sense strand, followed by (3' 4 5') a linker (e.g., C6-SS-C6). The linker can, in some embodiments, facilitate the linkage to additional components, such as, for example, a lipid or one or more targeting ligands. As described herein, the disulfide bond of C6-SS-C6 is first reduced, removing the dT from the molecule, which can then facilitate the conjugation of the desired component. The terminal dT nucleotide therefore is not a part of the fully conjugated construct.

In some embodiments, the antisense strand of a MAPT RNAi agent disclosed herein differs by 0, 1, 2, or 3 nucleotides from any of the antisense strand sequences in Table 3 or Table 10. In some embodiments, the sense strand of a MAPT RNAi agent disclosed herein differs by 0, 1, 2, or 3 nucleotides from any of the sense strand sequences in Table 4, Table 5, Table 6, or Table 9.

In some embodiments, a MAPT RNAi agent antisense strand comprises a nucleotide sequence of any of the sequences in Table 2 or Table 3. In some embodiments, a MAPT RNAi agent antisense strand comprises the sequence of nucleotides (from 5' end→3' end) 1-17, 2-17, 1-18, 2-18, 1-19, 2-19, 1-20, 2-20, 1-21, 2-21, 1-22, 2-22, 1-23, 2-23, 1-24, or 2-24 of any of the sequences in Table 2, Table 3, or Table 9. In certain embodiments, a MAPT RNAi agent antisense strand comprises or consists of a modified sequence of any one of the modified sequences in Table 3 or Table 9.

In some embodiments, a MAPT RNAi agent sense strand comprises the nucleotide sequence of any of the sequences in Table 2 or Table 4. In some embodiments, a MAPT RNAi agent sense strand comprises the sequence of nucleotides (from 5' end→3' end) 1-17, 2-17, 3-17, 4-17, 1-18, 2-18, 3-18, 4-18, 1-19, 2-19, 3-19, 4-19, 1-20, 2-20, 3-20, 4-20, 1-21, 2-21, 3-21, 4-21, 1-22, 2-22, 3-22, 4-22, 1-23, 2-23, 3-23, 4-23, 1-24, 2-24, 3-24, or 4-24, of any of the sequences in Table 2, Table 4, Table 5, Table 6, or Table 9. In certain embodiments, a MAPT RNAi agent sense strand comprises or consists of a modified sequence of any one of the modified sequences in Table 6 or Table 9.

For the RNAi agents disclosed herein, the nucleotide at position 1 of the antisense strand (from 5' end→3' end) can be perfectly complementary to a MAPT gene, or can be non-complementary to a MAPT gene. In some embodiments, the nucleotide at position 1 of the antisense strand (from 5' end→3' end) is a U, A, or dT (or a modified version of U, A or dT). In some embodiments, the nucleotide at position 1 of the antisense strand (from 5' end→3' end) forms an A:U or U:A base pair with the sense strand.

In some embodiments, a MAPT RNAi agent antisense strand comprises the sequence of nucleotides (from 5' end→3' end) 2-18 or 2-19 of any of the antisense strand sequences in Table 2, Table 3, or Table 9. In some embodiments, a MAPT RNAi sense strand comprises the sequence of nucleotides (from 5' end→3' end) 1-17 or 1-18 of any of the sense strand sequences in Table 2, Table 4, Table 5, Table 6, or Table 9.

In some embodiments, a MAPT RNAi agent includes (i) an antisense strand comprising the sequence of nucleotides (from 5' end→3' end) 2-18 or 2-19 of any of the antisense strand sequences in Table 2, Table 3, or Table 9, and (ii) a sense strand comprising the sequence of nucleotides (from 5' end→3' end) 1-17 or 1-18 of any of the sense strand sequences in Table 2, Table 4, Table 5, Table 6, or Table 9.

A sense strand containing a sequence listed in Table 2 or Table 4 can be hybridized to any antisense strand containing a sequence listed in Table 2 or Table 3 provided the two sequences have a region of at least 85% complementarity over a contiguous 16, 17, 18, 19, 20, or 21 nucleotide sequence. In some embodiments, the MAPT RNAi agent has a sense strand consisting of the modified sequence of any of the modified sequences in Table 4, Table 5, Table 6, or Table 9, and an antisense strand consisting of the modified sequence of any of the modified sequences in Table 3 or Table 9. Certain representative sequence pairings are exemplified by the Duplex ID Nos. shown in Tables 7, 8, and 9.

In some embodiments, a MAPT RNAi agent comprises, consists of, or consists essentially of a duplex represented by any one of the Duplex ID Nos. presented herein. In some embodiments, a MAPT RNAi agent consists of any of the Duplex ID Nos. presented herein. In some embodiments, a MAPT RNAi agent comprises the sense strand and antisense strand nucleotide sequences of any of the Duplex ID Nos. presented herein. In some embodiments, a MAPT RNAi agent comprises the sense strand and antisense strand nucleotide sequences of any of the Duplex ID Nos. presented herein and a targeting group, linking group, antigen binding protein and/or other non-nucleotide group wherein the targeting group, linking group, antigen binding protein and/or other non-nucleotide group is covalently linked (i.e., conjugated) to the sense strand or the antisense strand. In some embodiments, a MAPT RNAi agent includes the sense strand and antisense strand modified nucleotide sequences of any of the Duplex ID Nos. presented herein. In some embodiments, a MAPT RNAi agent comprises the sense strand and antisense strand modified nucleotide sequences of any of the Duplex ID Nos. presented herein and a targeting group, linking group, and/or other non-nucleotide group, wherein the targeting group, linking group, antigen binding protein and/or other non-nucleotide group is covalently linked to the sense strand or the antisense strand.

In some embodiments, a MAPT RNAi agent comprises an antisense strand and a sense strand having the nucleotide sequences of any of the antisense strand/sense strand duplexes of Tables 2, 7, 8, or 9, and comprises an antigen binding protein. In some embodiments, a MAPT RNAi agent comprises an antisense strand and a sense strand having the nucleotide sequences of any of the antisense strand/sense strand duplexes of Tables 2, 7, 8, or 9, and comprises one or more antigen binding proteins.

In some embodiments, a MAPT RNAi agent comprises an antisense strand and a sense strand having the nucleotide sequences of any of the antisense strand/sense strand duplexes of Tables 2, 7, 8, or 9, and comprises an antigen binding protein. In some embodiments, a MAPT RNAi agent comprises an antisense strand and a sense strand having the nucleotide sequences of any of the antisense strand/sense strand duplexes of Tables 2, 7, 8, or 9, and comprises one or more antigen binding protein.

In some embodiments, a MAPT RNAi agent comprises an antisense strand and a sense strand having the nucleotide sequences of any of the antisense strand/sense strand duplexes of Tables 2, 7, 8, or 9, and comprises a PK/PD modulator. In some embodiments, a MAPT RNAi agent comprises an antisense strand and a sense strand having the nucleotide sequences of any of the antisense strand/sense strand duplexes of Tables 2, 7, 8, or 9, and comprises one or more lipid moieties.

In some embodiments, a MAPT RNAi agent comprises an antisense strand and a sense strand having the nucleotide sequences of any of the antisense strand/sense strand duplexes of Tables 2, 7, 8, or 9, and comprises a lipid moiety. In some embodiments, a MAPT RNAi agent comprises an antisense strand and a sense strand having the nucleotide sequences of any of the antisense strand/sense strand duplexes of Tables 2, 7, 8, or 9, and comprises one or more lipid moieties.

In some embodiments, a MAPT RNAi agent comprises an antisense strand and a sense strand having the modified nucleotide sequences of any of the antisense strand/sense strand duplexes of Tables 7, 8, and 9.

In some embodiments, a MAPT RNAi agent comprises an antisense strand and a sense strand having the modified nucleotide sequences of any of the antisense strand/sense strand duplexes of Tables 7, 8, and 9, and comprises an antigen binding protein.

In some embodiments, a MAPT RNAi agent comprises an antisense strand and a sense strand having the modified nucleotide sequences of any of the antisense strand/sense strand duplexes of Tables 7, 8, and 9, and comprises a lipid moiety.

In some embodiments, a MAPT RNAi agent comprises, consists of, or consists essentially of any of the duplexes of Tables 7, 8, and 9.

TABLE 7

MAPT RNAi Agent Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC003990 | CA004894 | 545 | 741 | CS915429 | 739 | 777 |
| AC003991 | CA004895 | 546 | 742 | CS915429 | 739 | 777 |
| AC003992 | CA004894 | 545 | 741 | CS004896 | 693 | 776 |
| AC003993 | CA004897 | 547 | 743 | CS915429 | 739 | 777 |
| AC003994 | CA004898 | 548 | 743 | CS915429 | 739 | 777 |
| AC003995 | CA004899 | 549 | 743 | CS915429 | 739 | 777 |
| AC004123 | CA915905 | 592 | 743 | CS005096 | 694 | 777 |
| AC004124 | CA915905 | 592 | 743 | CS005097 | 695 | 777 |
| AC004125 | CA915905 | 592 | 743 | CS005098 | 696 | 777 |
| AC004126 | CA915905 | 592 | 743 | CS005099 | 697 | 777 |
| AC004130 | CA005104 | 550 | 744 | CS005103 | 698 | 778 |
| AC004265 | CA915404 | 584 | 766 | CS005303 | 699 | 779 |
| AC004396 | CA005435 | 551 | 741 | CS915429 | 739 | 777 |
| AC004434 | CA004894 | 545 | 741 | CS005470 | 700 | 780 |
| AC004435 | CA005471 | 552 | 745 | CS915429 | 739 | 777 |
| AC005033 | CA006181 | 553 | 746 | CS006178 | 701 | 781 |
| AC007414 | CA915905 | 592 | 743 | CS008817 | 702 | 777 |
| AC009806 | CA915905 | 592 | 743 | CS011528 | 703 | 777 |
| AC911178 | CA914417 | 554 | 747 | CS914416 | 704 | 782 |
| AC911179 | CA914417 | 554 | 747 | CS914418 | 705 | 783 |
| AC911180 | CA914420 | 555 | 748 | CS914419 | 706 | 784 |
| AC911181 | CA914422 | 556 | 749 | CS914421 | 707 | 785 |
| AC911182 | CA914424 | 557 | 750 | CS914423 | 708 | 786 |
| AC911183 | CA914426 | 558 | 751 | CS914425 | 709 | 787 |
| AC911184 | CA914428 | 559 | 752 | CS914427 | 710 | 788 |
| AC911185 | CA914430 | 560 | 753 | CS914429 | 711 | 789 |
| AC911186 | CA914432 | 561 | 754 | CS914431 | 712 | 790 |
| AC911187 | CA914434 | 562 | 755 | CS914433 | 713 | 791 |
| AC911188 | CA914436 | 563 | 756 | CS914435 | 714 | 792 |

TABLE 7-continued

MAPT RNAi Agent Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC911189 | CA914438 | 564 | 757 | CS914437 | 715 | 793 |
| AC911190 | CA914440 | 565 | 758 | CS914439 | 716 | 794 |
| AC911191 | CA914440 | 565 | 758 | CS914441 | 717 | 795 |
| AC911192 | CA914443 | 566 | 759 | CS914442 | 718 | 796 |
| AC911193 | CA914445 | 567 | 760 | CS914444 | 719 | 797 |
| AC911194 | CA914447 | 568 | 761 | CS914446 | 720 | 798 |
| AC911195 | CA914449 | 569 | 762 | CS914448 | 721 | 799 |
| AC911196 | CA914451 | 570 | 763 | CS914450 | 722 | 800 |
| AC911197 | CA914453 | 571 | 764 | CS914452 | 723 | 801 |
| AC911198 | CA914455 | 572 | 765 | CS914454 | 724 | 802 |
| AC911199 | CA914457 | 573 | 766 | CS914456 | 725 | 803 |
| AC911200 | CA914459 | 574 | 767 | CS914458 | 726 | 804 |
| AC911201 | CA914461 | 575 | 768 | CS914460 | 727 | 805 |
| AC911202 | CA914463 | 576 | 769 | CS914462 | 728 | 806 |
| AC911203 | CA914465 | 577 | 770 | CS914464 | 729 | 807 |
| AC911204 | CA914467 | 578 | 771 | CS914466 | 730 | 808 |
| AC911205 | CA914469 | 579 | 772 | CS914468 | 731 | 809 |
| AC911206 | CA914471 | 580 | 773 | CS914470 | 732 | 810 |
| AC911207 | CA914473 | 581 | 774 | CS914472 | 733 | 811 |
| AC911208 | CA914475 | 582 | 775 | CS914474 | 734 | 812 |
| AC911209 | CA914477 | 583 | 743 | CS914476 | 735 | 777 |
| AC912001 | CA914477 | 583 | 743 | CS915422 | 736 | 777 |
| AC912002 | CA915423 | 585 | 743 | CS915422 | 736 | 777 |
| AC912003 | CA915424 | 586 | 743 | CS915422 | 736 | 777 |
| AC912004 | CA915425 | 587 | 743 | CS915422 | 736 | 777 |
| AC912005 | CA915426 | 588 | 743 | CS915422 | 736 | 777 |
| AC912006 | CA915424 | 586 | 743 | CS915427 | 737 | 777 |
| AC912007 | CA915424 | 586 | 743 | CS915428 | 738 | 777 |
| AC912008 | CA915424 | 586 | 743 | CS915429 | 739 | 777 |
| AC912009 | CA915430 | 589 | 743 | CS915422 | 736 | 777 |
| AC912010 | CA915431 | 590 | 743 | CS915422 | 736 | 777 |
| AC912011 | CA915432 | 591 | 743 | CS915422 | 736 | 777 |
| AC912669 | CA915426 | 588 | 743 | CS915429 | 739 | 777 |
| AC912670 | CA916146 | 593 | 743 | CS915429 | 739 | 777 |
| AC912671 | CA915905 | 592 | 743 | CS915429 | 739 | 777 |
| AC912672 | CA916147 | 594 | 743 | CS915429 | 739 | 777 |
| AC912673 | CA916148 | 595 | 743 | CS915429 | 739 | 777 |
| AC912674 | CA916149 | 596 | 743 | CS915429 | 739 | 777 |
| AC912675 | CA916148 | 595 | 743 | CS916150 | 740 | 813 |

TABLE 8

Conjugate Duplex ID Numbers Referencing Position Targeted On MAPT (MAPT) Gene

| Duplex | AS ID | SS ID | Targeted MAPT Gene Position (Of SEQ ID NO: 1) |
|---|---|---|---|
| AC003990 | CA004894 | CS915429 | 1221 |
| AC003991 | CA004895 | CS915429 | 1221 |
| AC003992 | CA004894 | CS004896 | 1221 |
| AC003993 | CA004897 | CS915429 | 1221 |
| AC003994 | CA004898 | CS915429 | 1221 |
| AC003995 | CA004899 | CS915429 | 1221 |
| AC004123 | CA915905 | CS005096 | 1221 |
| AC004124 | CA915905 | CS005097 | 1221 |
| AC004125 | CA915905 | CS005098 | 1221 |
| AC004126 | CA915905 | CS005099 | 1221 |
| AC004130 | CA005104 | CS005103 | 340 |
| AC004265 | CA915404 | CS005303 | 935 |
| AC004396 | CA005435 | CS915429 | 1221 |
| AC004434 | CA004894 | CS005470 | 1221 |
| AC004435 | CA005471 | CS915429 | 1221 |
| AC005033 | CA006181 | CS006178 | 351 |
| AC007414 | CA915905 | CS008817 | 1221 |
| AC009806 | CA915905 | CS011528 | 1221 |
| AC911178 | CA914417 | CS914416 | 184 |
| AC911179 | CA914417 | CS914418 | 184 |
| AC911180 | CA914420 | CS914419 | 319 |
| AC911181 | CA914422 | CS914421 | 345 |
| AC911182 | CA914424 | CS914423 | 352 |
| AC911183 | CA914426 | CS914425 | 357 |
| AC911184 | CA914428 | CS914427 | 378 |
| AC911185 | CA914430 | CS914429 | 381 |
| AC911186 | CA914432 | CS914431 | 481 |
| AC911187 | CA914434 | CS914433 | 529 |
| AC911188 | CA914436 | CS914435 | 532 |
| AC911189 | CA914438 | CS914437 | 540 |
| AC911190 | CA914440 | CS914439 | 895 |
| AC911191 | CA914440 | CS914441 | 895 |
| AC911192 | CA914443 | CS914442 | 897 |
| AC911193 | CA914445 | CS914444 | 898 |
| AC911194 | CA914447 | CS914446 | 900 |
| AC911195 | CA914449 | CS914448 | 908 |
| AC911196 | CA914451 | CS914450 | 931 |
| AC911197 | CA914453 | CS914452 | 933 |
| AC911198 | CA914455 | CS914454 | 934 |
| AC911199 | CA914457 | CS914456 | 935 |

TABLE 8-continued

Conjugate Duplex ID Numbers Referencing Position Targeted On MAPT (MAPT) Gene

| Duplex | AS ID | SS ID | Targeted MAPT Gene Position (Of SEQ ID NO: 1) |
|---|---|---|---|
| AC911200 | CA914459 | CS914458 | 941 |
| AC911201 | CA914461 | CS914460 | 948 |
| AC911202 | CA914463 | CS914462 | 949 |
| AC911203 | CA914465 | CS914464 | 951 |
| AC911204 | CA914467 | CS914466 | 979 |
| AC911205 | CA914469 | CS914468 | 1083 |
| AC911206 | CA914471 | CS914470 | 1085 |
| AC911207 | CA914473 | CS914472 | 1086 |
| AC911208 | CA914475 | CS914474 | 1118 |
| AC911209 | CA914477 | CS914476 | 1221 |
| AC912001 | CA914477 | CS915422 | 1221 |
| AC912002 | CA915423 | CS915422 | 1221 |
| AC912003 | CA915424 | CS915422 | 1221 |
| AC912004 | CA915425 | CS915422 | 1221 |
| AC912005 | CA915426 | CS915422 | 1221 |
| AC912006 | CA915424 | CS915427 | 1221 |
| AC912007 | CA915424 | CS915428 | 1221 |
| AC912008 | CA915424 | CS915429 | 1221 |
| AC912009 | CA915430 | CS915422 | 1221 |
| AC912010 | CA915431 | CS915422 | 1221 |
| AC912011 | CA915432 | CS915422 | 1221 |
| AC912669 | CA915426 | CS915429 | 1221 |
| AC912670 | CA916146 | CS915429 | 1221 |
| AC912671 | CA915905 | CS915429 | 1221 |
| AC912672 | CA916147 | CS915429 | 1221 |
| AC912673 | CA916148 | CS915429 | 1221 |
| AC912674 | CA916149 | CS915429 | 1221 |
| AC912675 | CA916148 | CS916150 | 1221 |

TABLE 9

Conjugate ID Numbers With Chemically Modified Antisense and Sense Strands (including Linkers and Conjugates)

| ACID Number | Sense Strand (fully modified with conjugated antigen binding protein or conjugated PK/PD modulator) (5' → 3') | SEQ ID NO: | Antisense Strand (5' → 3') | SEQ ID NO: |
|---|---|---|---|---|
| AC003990 | LP293-(NH-C6)s(invAb)scagcaucgAfcAfUfgguagacuas(invAb) | 739 | cPrpusAfsgucuAfccauGfuUfgAfugcussg | 545 |
| AC003991 | LP293-(NH-C6)s(invAb)scagcaucgAfcAfUfgguagacuas(invAb) | 739 | cPrpusAfsgucuAfcuauGfuCfgAfugcussg | 546 |
| AC003992 | LP293-(NH-C6)s(invAb)scagcaucgAfuAfUfgguagacuas(invAb) | 693 | cPrpusAfsgucuAfccauGfuUfgAfugcussg | 545 |
| AC003993 | LP293-(NH-C6)s(invAb)scagcaucgAfcAfUfgguagacuas(invAb) | 739 | cPrpusAfsgucuAfCUNAcauGfuCfgAfugcussg | 547 |
| AC003994 | LP293-(NH-C6)s(invAb)scagcaucgAfcAfUfgguagacuas(invAb) | 739 | cPrpusAfsgucUUNAAfccauGfuCfgAfugcussg | 548 |
| AC003995 | LP293-(NH-C6)s(invAb)scagcaucgAfcAfUfgguagacuas(invAb) | 739 | cPrpusAfsgucudAccauGfuCfgAfugcussg | 549 |
| AC004123 | LP310-(NH-C6)s(invAb)scagcaucgAfcAfUfgguagacuas(invAb) | 694 | cPrpusAfsgucuAfccauGfuCfgAfugcussg | 592 |
| AC004124 | LP429-(NH-C6)s(invAb)scagcaucgAfcAfUfgguagacuas(invAb) | 695 | cPrpusAfsgucuAfccauGfuCfgAfugcussg | 592 |
| AC004125 | LP462-(NH-C6)s(invAb)scagcaucgAfcAfUfgguagacuas(invAb) | 696 | cPrpusAfsgucuAfccauGfuCfgAfugcussg | 592 |
| AC004126 | (invAb)scagcauC16cgAfcAfUfgguagacuas(invAb) | 697 | cPrpusAfsgucuAfccauGfuCfgAfugcussg | 592 |
| AC004130 | gsusgaccC16caAfGfCfucguauggsusa | 698 | vpusAfsccdAudAcgagcuUfgGfgucacsgsu | 550 |
| AC004265 | LP293-(NH-C6)s(invAb)sccaaguGfuGfgCfucauuaggsuas(invAb) | 699 | cPrpusGfsccuaAfugagCfcAfcAfcuugsg | 584 |
| AC004396 | LP293-(NH-C6)s(invAb)scagcaucgAfcAfUfgguagacuas(invAb) | 739 | cPrpusAfsgucUUNAAfccauGfuUfgAfugcussg | 551 |
| AC004434 | LP293-(NH-C6)s(invAb)scagcaucaAfcAfUfgguagacuas(invAb) | 700 | cPrpusAfsgucuAfccauGfuUfgAfugcussg | 545 |
| AC004435 | LP293-(NH-C6)s(invAb)scagcaucgAfcAfUfgguagacuas(invAb) | 739 | cPrpusAfsgucuAfccauGfudTgAfugcussg | 552 |

TABLE 9-continued

Conjugate ID Numbers With Chemically Modified Antisense and
Sense Strands (including Linkers and Conjugates)

| ACID Number | Sense Strand (fully modified with conjugated antigen binding protein or conjugated PK/PD modulator) (5' → 3') | SEQ ID NO: | Antisense Strand (5' → 3') | SEQ ID NO: |
|---|---|---|---|---|
| AC005033 | LP293-(NH-C6)s(invAb)sucgcauggUfcAfguaaaagcaas(invAb) | 701 | cPrpusUfsgcuUUNAUfuacuGfaCfcAfugcgssa | 553 |
| AC007414 | Fab0070-[CP-1113]-L20-(NH-C6)s(invAb)scagcaucgAfcAfUfgguagacuas(invAb) | 702 | cPrpusAfsgucuAfccauGfuCfgAfugcussg | 592 |
| AC009806 | Fab0070-L-1026-(NH-C6)s(invAb)scagcaucgAfcAfUfgguagacuas(invAb) | 703 | cPrpusAfsgucuAfccauGfuCfgAfugcussg | 592 |
| AC911178 | LP183-(NH-C6)s(invAb)sgaagaucaCfGfCfugggaciuaas(invAb) | 704 | cPrpusUfsasCfgUfcccagCfgUfgAfuCfuusc | 554 |
| AC911179 | LP183-(NH-C6)s(invAb)sgaagaucaCfGfCfugggauguaas(invAb) | 705 | cPrpusUfsasCfgUfcccagCfgUfgAfuCfuusc | 554 |
| AC911180 | LP183-(NH-C6)s(invAb)sgaagacgaAfGfCfugcuigucaas(invAb) | 706 | cPrpusUfsgsAfcCfagcagCfuUfcGfuCfuusc | 555 |
| AC911181 | LP183-(NH-C6)s(invAb)sccaagcucGfCfAfuggucaguaas(invAb) | 707 | cPrpusUfsasCfuGfaccauGfcGfaGfcUfugsg | 556 |
| AC911182 | LP183-(NH-C6)s(invAb)scgcaugguCfAfGfuaaaagcaaas(invAb) | 708 | cPrpusUfsusGfcUfuuuacUfgAfcCfaUfgcsg | 557 |
| AC911183 | LP183-(NH-C6)s(invAb)sggucaguaAfAfAfgcaaagacias(invAb) | 709 | cPrpusCfsgsUfcUfuugcuUfuUfaCfuGfacsc | 558 |
| AC911184 | LP183-(NH-C6)s(invAb)sgacuggaaGfCfGfaugacaaaaas(invAb) | 710 | cPrpusUfsusUfuGfucaucGfcUfuCfcAfgusc | 559 |
| AC911185 | LP183-(NH-C6)s(invAb)suggaagcgAfUfGfacaaaaaagas(invAb) | 711 | cPrpusCfsusUfuUfuugucAfuCfgCfuUfccsa | 560 |
| AC911186 | LP183-(NH-C6)s(invAb)saccaggauUfCfCfagcaaaaacas(invAb) | 712 | cPrpusGfsusUfuUfugcugGfaAfuCfcUfggsu | 561 |
| AC911187 | LP183-(NH-C6)s(invAb)sucggugaAfCfCfuccaaaaucas(invAb) | 713 | cPrpusGfsasUfuUfuggagGfuUfcAfcCfagsa | 562 |
| AC911188 | LP183-(NH-C6)s(invAb)sggugaaccUfCfCfaaaaucaigas(invAb) | 714 | cPrpusCfscsUfgAfuuuugGfaGfgUfuCfacsc | 563 |
| AC911189 | LP183-(NH-C6)s(invAb)succa_2NaaauCfAfGfgggaucicaas(invAb) | 715 | cPrpusUfsgsCfgAfuccccUfgAfuUfuUfggsa | 564 |
| AC911190 | LP183-(NH-C6)s(invAb)scaa_2NauaguCfUfAfcaaaccaguus(invAb) | 716 | cPrpasAfscsUfgGfuuuguAfgAfcUfaUfuusg | 565 |
| AC911191 | LP183-(NH-C6)s(invAb)scaa_2NauaguCfUfAfcaaacuaguus(invAb) | 717 | cPrpasAfscsUfgGfuuuguAfgAfcUfaUfuusg | 565 |
| AC911192 | LP183-(NH-C6)s(invAb)sa_2NauagucuAfCfAfaaccaiuugas(invAb) | 718 | cPrpusCfsasAfcUfgguuuGfuAfgAfcUfaususu | 566 |
| AC911193 | LP183-(NH-C6)s(invAb)sa_2NuagucuaCfAfAfaccaguugaas(invAb) | 719 | cPrpusUfscsAfaCfugguuUfgUfaGfaCfuasu | 567 |
| AC911194 | LP183-(NH-C6)s(invAb)sagucuacaAfAfCfcaguuiaccus(invAb) | 720 | cPrpasGfsgsUfcCfacuggUfuUfgUfaGfacsu | 568 |
| AC911195 | LP183-(NH-C6)s(invAb)saaccaguuGfAfCfcugaicaagas(invAb) | 721 | cPrpusCfsusUfgCfucaggUfcAfaCfuGfgusu | 569 |
| AC911196 | LP183-(NH-C6)s(invAb)saccuccaaGfUfGfuggcucauuas(invAb) | 722 | cPrpusAfsasUfgAfgccacAfcUfuGfgAfggsu | 570 |
| AC911197 | LP183-(NH-C6)s(invAb)scuccaaguGfUfGfgcucauuagas(invAb) | 723 | cPrpusCfsusAfaUfgagccAfcAfcUfuGfgasg | 571 |

TABLE 9-continued

Conjugate ID Numbers With Chemically Modified Antisense and
Sense Strands (including Linkers and Conjugates)

| ACID Number | Sense Strand (fully modified with conjugated antigen binding protein or conjugated PK/PD modulator) (5' → 3') | SEQ ID NO: | Antisense Strand (5' → 3') | SEQ ID NO: |
|---|---|---|---|---|
| AC911198 | LP183-(NH-C6)s(invAb)succaagug UfGfGfcucauuaggas(invAb) | 724 | cPrpusCfscsUfaAfugagcCfaCfaCfu Ufggsa | 572 |
| AC911199 | LP183-(NH-C6)s(invAb)sccaagugu GfGfCfucauuagicas(invAb) | 725 | cPrpusGfscsCfuAfaugagCfcAfcAfc TABLE 9-continued Conjugate ID Numbers With Chemically Modified Antisense and
Sense Strands (including Linkers and Conjugates)

| ACID Number | Sense Strand (fully modified with conjugated antigen binding protein or conjugated PK/PD modulator) (5' → 3') | SEQ ID NO: | Antisense Strand (5' → 3') | SEQ ID NO: |
| --- | --- | --- | --- | --- |
| AC912670 | LP293-(NH-C6)s(invAb)scagcaucg AfcAfUfgguagacuas(invAb) | 739 | cPrpusAfsgucuAfccauGfuCfgAfugc susg | 593 |
| AC912671 | LP293-(NH-C6)s(invAb)scagcaucg AfcAfUfgguagacuas(invAb) | 739 | cPrpusAfsgucuAfccauGfuCfgAfugc ussg | 592 |
| AC912672 | LP293-(NH-C6)s(invAb)scagcaucg AfcAfUfgguagacuas(invAb) | 739 | cPrpusAfsgucuAUNAccauGfuCfgAfu gcusg | 594 |
| AC912673 | LP293-(NH-C6)s(invAb)scagcaucg AfcAfUfgguagacuas(invAb) | 739 | cPrpusAfsgucudAccauGfuCfgdAugc usg | 595 |
| AC912674 | LP293-(NH-C6)s(invAb)scagcaucg AfcAfUfgguagacuas(invAb) | 739 | cPrpusAfsgucudAccaudGuCfgdAugc usg | 596 |
| AC912675 | LP293-(NH-C6)s(invAb)scagcaucg AfcAfdTgguagacuas(invAb) | 740 | cPrpusAfsgucudAccauGfuCfgdAugc usg | 595 |

In some embodiments, a MAPT RNAi agent is prepared or provided as a salt, mixed salt, or a free-acid. In some embodiments, a MAPT RNAi agent is prepared or provided as a pharmaceutically acceptable salt. In some embodiments, a MAPT RNAi agent is prepared or provided as a pharmaceutically acceptable sodium or potassium salt The RNAi agents described herein, upon delivery to a cell expressing a MAPT gene, inhibit or knockdown expression of one or more MAPT genes in vivo and/or in vitro.

Targeting Groups, Linking Groups, Lipid PK/PD Moieties, and Delivery Vehicles

In some embodiments, a MAPT RNAi agent contains or is conjugated to one or more non-nucleotide groups including, but not limited to, a targeting group, a linking group, a delivery polymer, a pharmacokinetic/pharmacodynamic (PK/PD) modulator, or a delivery vehicle. The non-nucleotide group can enhance targeting, delivery, or attachment of the RNAi agent. The non-nucleotide group can be covalently linked to the 3' and/or 5' end of either the sense strand and/or the antisense strand. In some embodiments, a MAPT RNAi agent contains a non-nucleotide group linked to the 3' and/or 5' end of the sense strand. In some embodiments, a non-nucleotide group is linked to the 5' end of a MAPT RNAi agent sense strand. A non-nucleotide group can be linked directly or indirectly to the RNAi agent via a linker/linking group. In some embodiments, a non-nucleotide group is linked to the RNAi agent via a labile, cleavable, or reversible bond or linker.

In some embodiments, a non-nucleotide group enhances the pharmacokinetic or biodistribution properties of an RNAi agent or conjugate to which it is attached to improve cell- or tissue-specific distribution and cell-specific uptake of the conjugate. In some embodiments, a non-nucleotide group enhances endocytosis of the RNAi agent.

Targeting groups or targeting moieties enhance the pharmacokinetic or biodistribution properties of a conjugate or RNAi agent to which they are attached to improve cell-specific (including, in some cases, organ specific) distribution and cell-specific (or organ specific) uptake of the conjugate or RNAi agent. A targeting group can be monovalent, divalent, trivalent, tetravalent, or have higher valency for the target to which it is directed. Representative targeting groups include, without limitation, compounds with affinity to cell surface molecule, cell receptor ligands, hapten, antibodies, monoclonal antibodies, antibody fragments, and antibody mimics with affinity to cell surface molecules. In some embodiments, a targeting group is linked to an RNAi agent using a linker, such as a PEG linker or one, two, or three abasic and/or ribitol (abasic ribose) residues, which in some instances can serve as linkers.

A targeting group, with or without a linker, can be attached to the 5' or 3' end of any of the sense and/or antisense strands disclosed in Tables 2, 3, 4, 5, 6, and 9. A linker, with or without a targeting group, can be attached to the 5' or 3' end of any of the sense and/or antisense strands disclosed in Tables 2, 3, 4, 5, 6, and 9.

The MAPT RNAi agents described herein can be synthesized having a reactive group, such as an amino group (also referred to herein as an amine), at the 5'-terminus and/or the 3'-terminus. The reactive group can be used subsequently to attach a targeting moiety using methods typical in the art.

For example, in some embodiments, the MAPT RNAi agents disclosed herein are synthesized having an $NH_2$-$C_6$ group at the 5'-terminus of the sense strand of the RNAi agent. The terminal amino group subsequently can be reacted to form a conjugate with, for example, a group that includes a lipid moiety or an antigen binding protein. In some embodiments, the MAPT RNAi agents disclosed herein are synthesized having one or more alkyne groups at the 5'-terminus of the sense strand of the RNAi agent.

In some embodiments, targeting groups are linked to the MAPT RNAi agents without the use of an additional linker. In some embodiments, the targeting group is designed having a linker readily present to facilitate the linkage to a MAPT RNAi agent. In some embodiments, when two or more RNAi agents are included in a composition, the two or more RNAi agents can be linked to their respective targeting groups using the same linkers. In some embodiments, when two or more RNAi agents are included in a composition, the two or more RNAi agents are linked to their respective targeting groups using different linkers.

In some embodiments, a linking group is conjugated to the RNAi agent. The linking group facilitates covalent linkage of the agent to a targeting group, pharmacokinetic modulator, delivery polymer, or delivery vehicle. The linking group can be linked to the 3' and/or the 5' end of the RNAi agent sense strand or antisense strand. In some embodiments, the linking group is linked to the RNAi agent sense strand. In some embodiments, the linking group is conjugated to the 5' or 3' end of an RNAi agent sense strand. In some embodiments, a linking group is conjugated to the 5' end of an RNAi agent sense strand. Examples of linking groups, include but are not limited to: C6-SS-C6, 6-SS-6, reactive groups such a primary amines (e.g., NH2-C6) and alkynes, alkyl groups, abasic residues/nucleotides, amino acids, tri-alkyne functionalized groups, ribitol, and/or PEG groups. Examples of certain linking groups are provided in Table 10.

A linker or linking group is a connection between two atoms that links one chemical group (such as an RNAi agent) or segment of interest to another chemical group (such as a targeting group, pharmacokinetic modulator, or delivery polymer) or segment of interest via one or more covalent bonds. A labile linkage contains a labile bond. A linkage can optionally include a spacer that increases the distance between the two joined atoms. A spacer may further add flexibility and/or length to the linkage. Spacers include, but are not to be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description. In some embodiments, a MAPT RNAi agent is conjugated to a polyethylene glycol (PEG) moiety, or to a hydrophobic group having 12 or more carbon atoms, such as a cholesterol or palmitoyl group.

In some embodiments, a MAPT RNAi agent is linked to one or more antigen binding proteins. Antigen binding proteins may enhance the bioavailability of the RNAi agent, the delivery of the RNAi agent to a cell of interest, or the facilitation of shuttling the RNAi agent across the blood brain barrier. In some embodiments, the antigen binding protein may be conjugated to a linker at the 3' or 5' end of a sense strand or an antisense strand of an RNAi agent described herein. In some embodiments, an antigen binding protein may be linked at both the 3' or 5' end of either the sense strand or the antisense strand of an RNAi agent described herein.

In some embodiments, a MAPT RNAi agent is linked to one or more lipid PK/PD moieties (referred to herein as "lipid moieties" or "PK/PD modulators".) Lipid PK/PD moieties may enhance the pharmacodynamic or pharmacokinetic properties of the RNAi agent. In some embodiments, the lipid moiety may be conjugated to a linker at the 3' or 5' end of a sense strand or an antisense strand of an RNAi agent described herein. In some embodiments, a lipid moiety may be linked at both the 3' or 5' end of either the sense strand or the antisense strand of an RNAi agent described herein. Examples of PK/PD modulators may be found, for example, in PCT Publication No. WO2023/245061, which is incorporated by reference in its entirety herein.

In some embodiments, an antigen binding protein may be conjugated to a MAPT RNAi agent by reacting a MAPT RNAi agent comprising an amine-comprising linker, for example, (NH2-C6) (see Table 10). In some embodiments, the amine-comprising linker may be located on the 5' end of the sense strand or the antisense strand of a MAPT RNAi agent. In some embodiments, the amine-comprising linker may be located on the 3' end of the sense strand or the antisense strand of an RNAi agent.

In some embodiments, a lipid moiety may be conjugated to a MAPT RNAi agent by reacting a MAPT RNAi agent comprising an amine-comprising linker, for example, (NH2-C6) (see Table 10). In some embodiments, the amine-comprising linker may be located on the 5' end of the sense strand or the antisense strand of a MAPT RNAi agent. In some embodiments, the amine-comprising linker may be located on the 3' end of the sense strand or the antisense strand of an RNAi agent.

Any of the MAPT RNAi agent nucleotide sequences listed in Tables 2, 3, 4, 5, 6, and 9, whether modified or unmodified, can contain 3' and/or 5' targeting group(s), linking group(s), and/or antigen binding fragments. Any of the MAPT RNAi agent duplexes listed in Tables 7, 8, and 9, whether modified or unmodified, can further comprise a targeting group or linking group, but not limited to, those depicted in Table 10, and the targeting group or linking group can be attached to the 3' or 5' terminus of either the sense strand or the antisense strand of the MAPT RNAi agent duplex.

In some embodiments, an RNAi agent comprising an amine-comprising linker, such as (NH2-C6) or (NH2-C6)s, may be reacted with a lipid comprising an activated ester moiety.

In some embodiments, a MAPT RNAi agent may be conjugated to a lipid moiety using phosphoramidite synthesis. Synthesizing oligonucleotides using phosphoramidites is well-known in the art. In some embodiments, a lipid moiety may be conjugated to the 5' end of the sense strand or the antisense strand of a MAPT RNAi agent using a phosphoramidite. In some embodiments, a lipid moiety may be conjugated to the 3' end of the sense strand or the antisense strand of a MAPT RNAi agent using a phosphoramidite. In some embodiments, a phosphoramidite may be used to conjugate a lipid moiety to a MAPT RNAi agent.

In some embodiments, MAPT RNAi agents may comprise a lipid moiety on an internal nucleotide (i.e., not on the 3' or 5' terminal nucleotides.) In some embodiments, an internal nucleotide may be linked to the 2' position of ribose.

Any of the MAPT RNAi agent nucleotide sequences listed in Tables 2, 3, 4, 5, 6, and 9, whether modified or unmodified, can contain 3' and/or 5' targeting group(s), linking group(s), and/or lipid PK/PD moieties. Any of the MAPT RNAi agent sequences listed in Tables 3, 4, 5, 6, and 9, or are otherwise described herein, which contain a 3' or 5' targeting group, linking group, and/or lipid PK/PD moiety can alternatively contain no 3' or 5' targeting group, linking group, or lipid PK/PD moiety, or can contain a different 3' or 5' targeting group, linking group, or lipid PK/PD moiety including, but not limited to, those depicted in Table 10. Any of the MAPT RNAi agent duplexes listed in Tables 7, 8, and 9, whether modified or unmodified, can further comprise a targeting group, linking group, or PK/PD moiety including, but not limited to, those depicted in Table 10, and the targeting group, linking group or PK/PD moiety can be attached to the 3' or 5' terminus of either the sense strand or the antisense strand of the MAPT RNAi agent duplex.

Examples of certain modified nucleotides, capping moieties, and linking groups are provided in Table 10.

TABLE 10
Structures Representing Various Modified Nucleotides, Capping Moieties, Lipid PK/PD Moieties, and Linking Groups (wherein ⌇ indicates the point of connection)
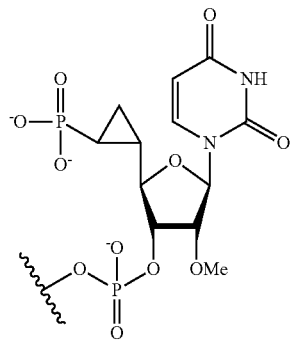
cPrpu
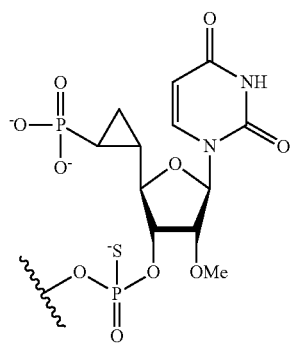
cPrpus
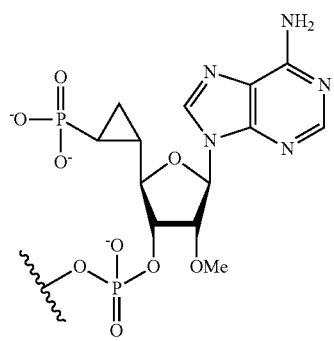
cPrpa
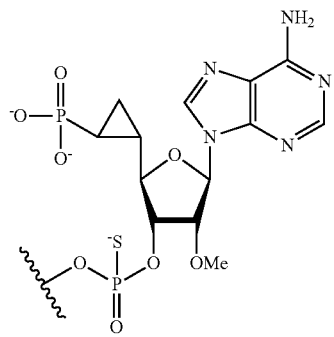
cPrpas TABLE 10-continued
Structures Representing Various Modified Nucleotides, Capping Moieties, Lipid PK/PD Moieties, and Linking Groups (wherein ⌇ indicates the point of connection)
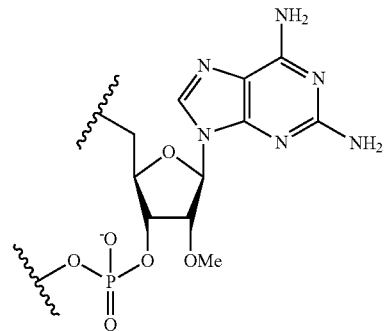
a_2N
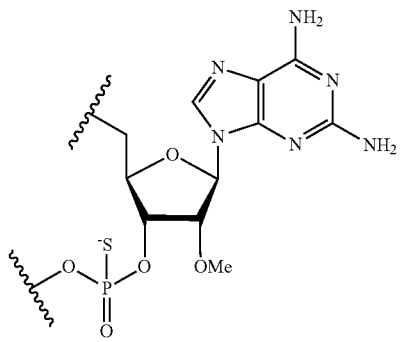
a_2Ns
When positioned internally:
linkage towards 5' end
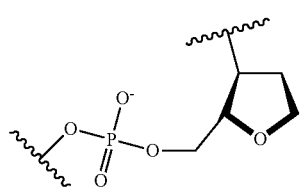
linkage towards 3' end
(invAb)
linkage towards 5' end
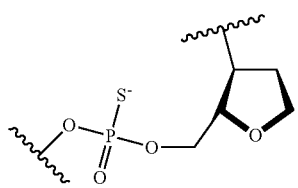
linkage towards 3' end
(invAb)s TABLE 10-continued Structures Representing Various Modified Nucleotides, Capping Moieties, Lipid PK/PD Moieties, and Linking Groups (wherein ⁞ indicates the point of connection)

linkage towards 5' end

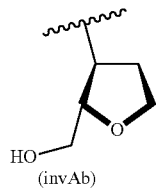

(invAb)
When position at the 3' terminal end:

linkage towards 5' end

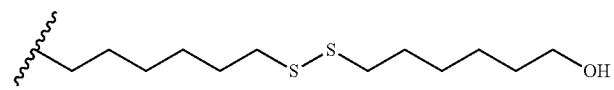

(C6-SS-C6)
When positioned internally:

linkage towards 5' end                                    linkage towards 3' end

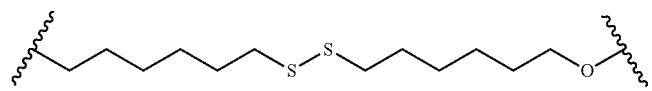

(C6-SS-C6)
When position at the 3' terminal end:

linkage towards 5' end

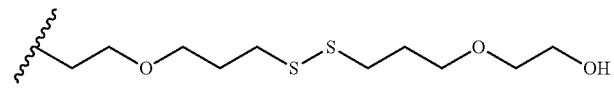

(6-SS-6)
When positioned internally:

linkage towards 5' end                                    linkage towards 3' end

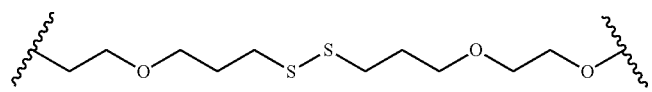

(6-SS-6)

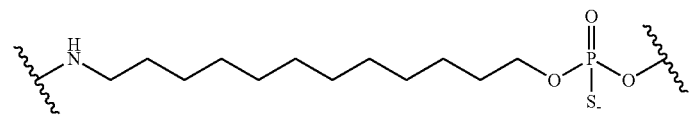

(NHC12)s

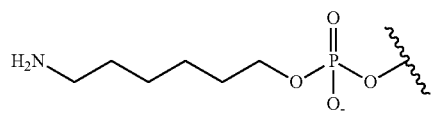

(NH2-C6)

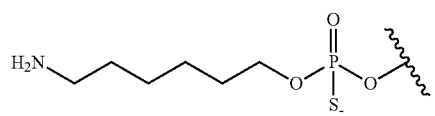

(NH2-C6)s

TABLE 10-continued
Structures Representing Various Modified Nucleotides, Capping Moieties, Lipid PK/PD Moieties, and Linking Groups (wherein ┊ indicates the point of connection)
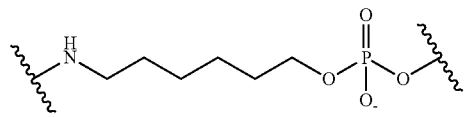
(NH-C6)
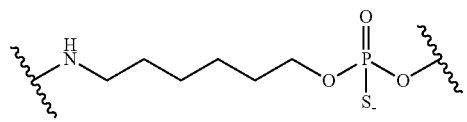
(NH-C6)s
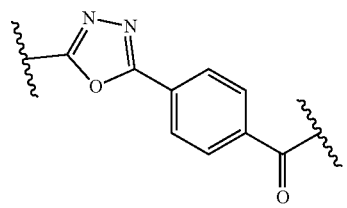 [SMILES: *C(=O)c1ccc(-c2nnc(*)o2)cc1]
L20
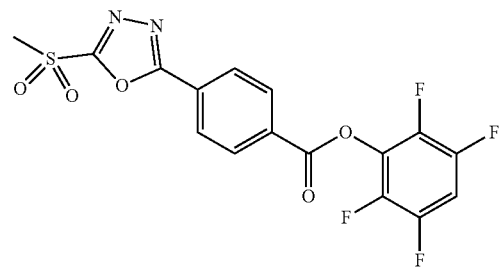 [SMILES: CS(=O)(=O)c1nnc(-c2ccc(C(=O)Oc3c(F)c(F)cc(F)c3F)cc2)o1]
L20-p
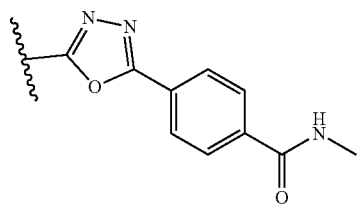 [SMILES: *c1nnc(-c2ccc(C(=O)NC)cc2)o1]
[CP-1113]
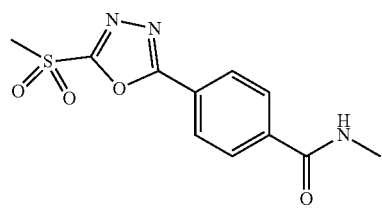
CP-1113-p TABLE 10-continued
Structures Representing Various Modified Nucleotides, Capping Moieties, Lipid
PK/PD Moieties, and Linking Groups (wherein ⁅ indicates the point of connection)
Linkage toward RNAi agent
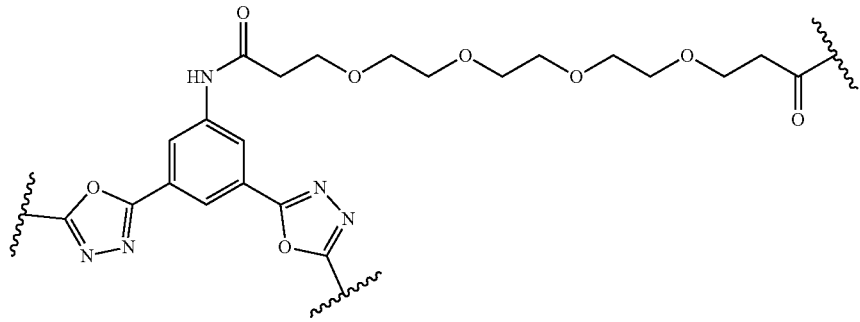
Linkage to Fab
L-1026
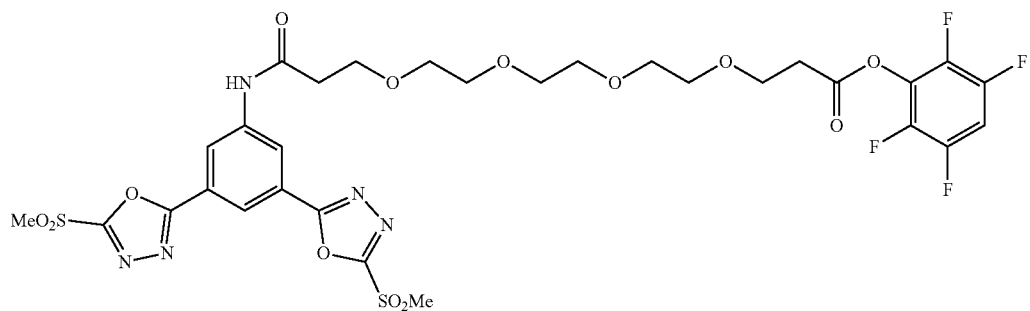 [SMILES: CS(=O)(=O)c1nnc(-c2cc(NC(=O)CCOCCOCCOCCOCCC(=O)Oc3c(F)c(F)cc(F)c3F)cc(-c3nnc(S(C)(=O)=O)o3)c2)o1]
L-1026-p
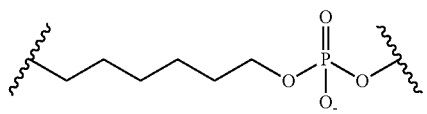
(C6)
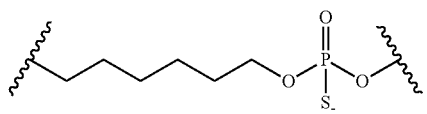
(C6)s
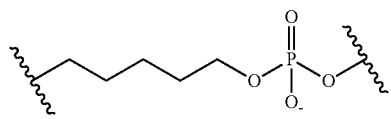
(C5)
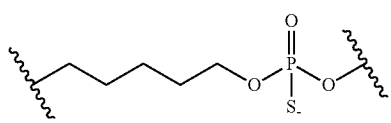
(C5)s TABLE 10-continued
Structures Representing Various Modified Nucleotides, Capping Moieties, Lipid PK/PD Moieties, and Linking Groups (wherein ⸹ indicates the point of connection)
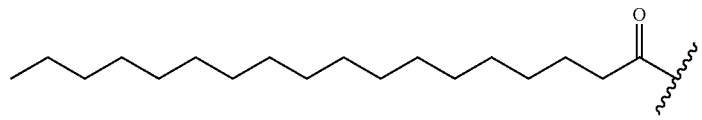 [SMILES: *C(=O)CCCCCCCCCCCCCCCCC]
LP128
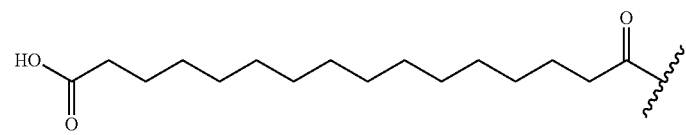 [SMILES: *C(=O)CCCCCCCCCCCCCCC(=O)O]
LP132
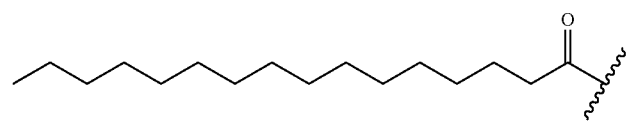 [SMILES: *C(=O)CCCCCCCCCCCCCCC]
LP183
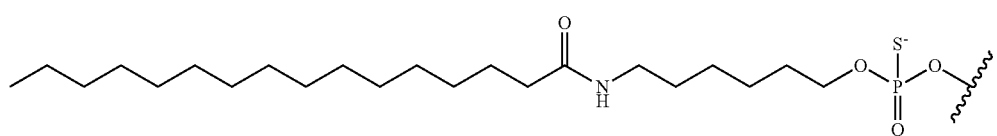
LP183-(NH-C6)s
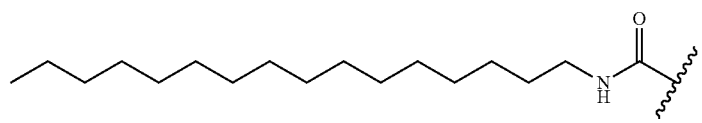 [SMILES: *C(=O)NCCCCCCCCCCCCCCCC]
LP183r
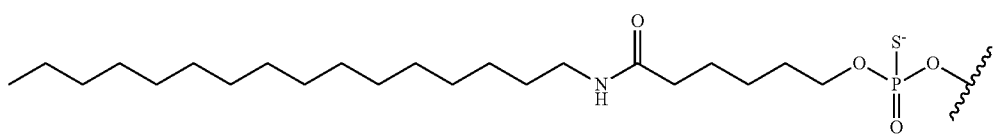
LP183r-(C5)s
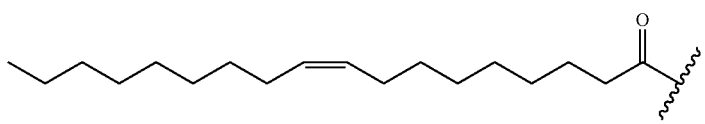 [SMILES: *C(=O)CCCCCCC/C=C\CCCCCCCC]
LP200
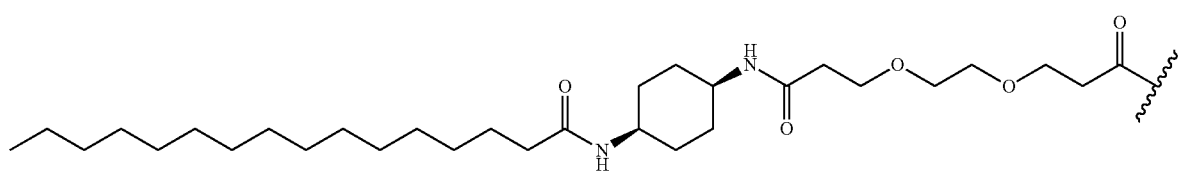 [SMILES: *C(=O)CCOCCOCCC(=O)N[C@H]1CC[C@@H](NC(=O)CCCCCCCCCCCCCCC)CC1]
LP232

TABLE 10-continued
Structures Representing Various Modified Nucleotides, Capping Moieties, Lipid PK/PD Moieties, and Linking Groups (wherein ⁣ indicates the point of connection)
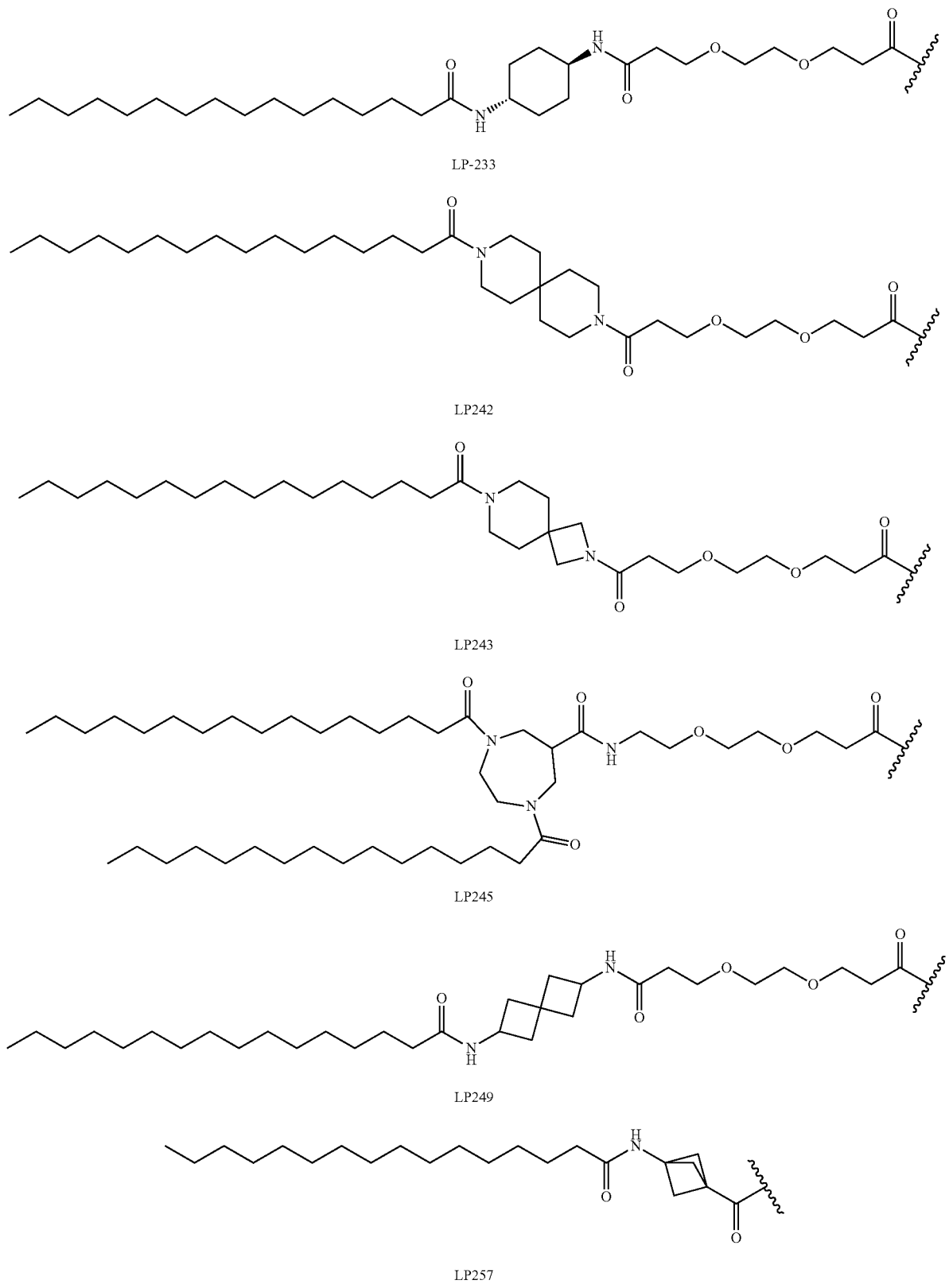
LP-233
LP242
LP243
LP245
LP249
LP257

TABLE 10-continued
Structures Representing Various Modified Nucleotides, Capping Moieties, Lipid
PK/PD Moieties, and Linking Groups (wherein ⁁ indicates the point of connection)
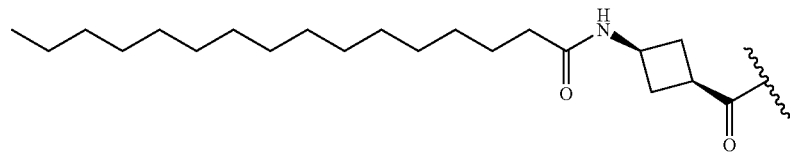 [SMILES: *C(=O)[C@H]1C[C@@H](NC(=O)CCCCCCCCCCCCCCC)C1]
LP259
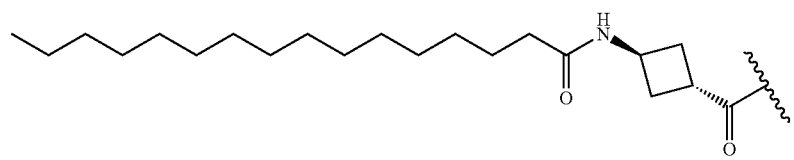 [SMILES: *C(=O)[C@H]1C[C@H](NC(=O)CCCCCCCCCCCCCCC)C1]
LP260
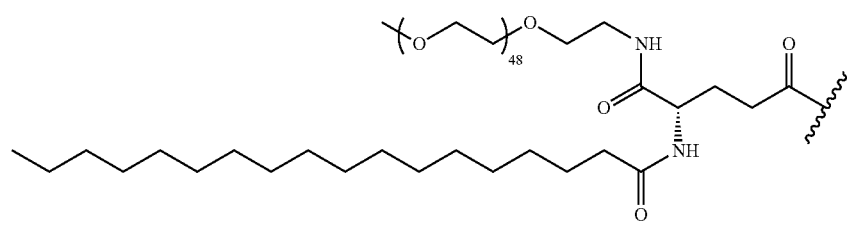
LP262
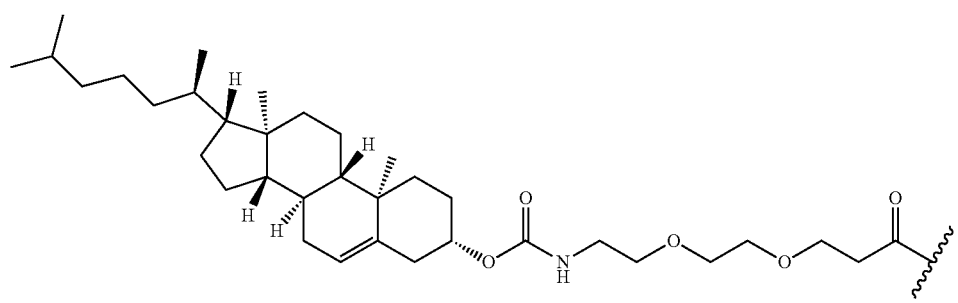 [SMILES: *C(=O)CCOCCOCCNC(=O)O[C@H]1CC[C@@]2(C)C(=CC[C@H]3[C@@H]4CC[C@H]([C@H](C)CCCC(C)C)[C@@]4(C)CC[C@@H]32)C1]
LP269
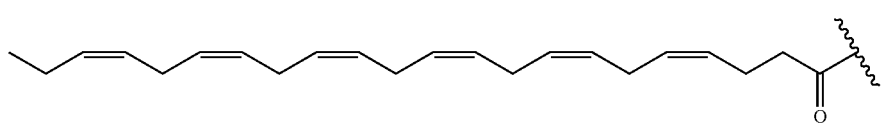 [SMILES: *C(=O)CC/C=C\C/C=C\C/C=C\C/C=C\C/C=C\C/C=C\CC]
LP273
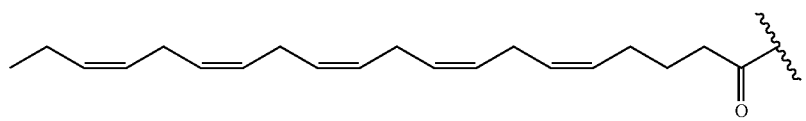 [SMILES: *C(=O)CCC/C=C\C/C=C\C/C=C\C/C=C\C/C=C\CC]
LP274
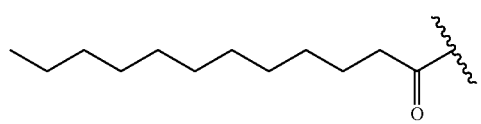 [SMILES: *C(=O)CCCCCCCCCCC]
LP276

TABLE 10-continued
Structures Representing Various Modified Nucleotides, Capping Moieties, Lipid PK/PD Moieties, and Linking Groups (wherein ⁒ indicates the point of connection)
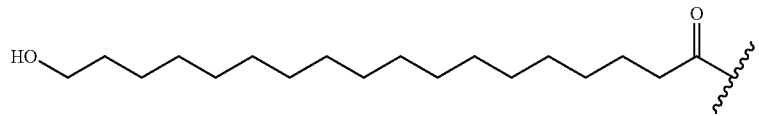 [SMILES: *C(=O)CCCCCCCCCCCCCCCCCO]
LP283
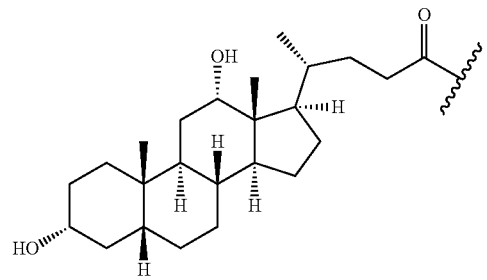
LP286
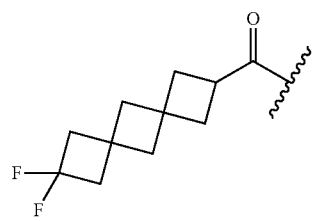 [SMILES: *C(=O)C1CC2(C1)CC1(CC(F)(F)C1)C2]
LP287
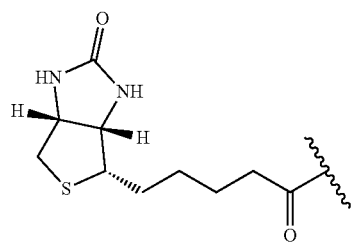 [SMILES: *C(=O)CCCC[C@@H]1SC[C@@H]2NC(=O)N[C@@H]21]
LP289
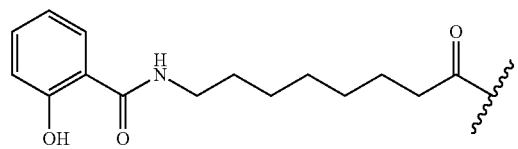 [SMILES: *C(=O)CCCCCCCNC(=O)c1ccccc1O]
LP290
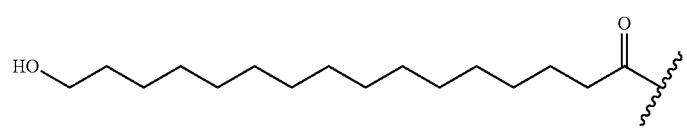 [SMILES: *C(=O)CCCCCCCCCCCCCCCO]
LP293

TABLE 10-continued
Structures Representing Various Modified Nucleotides, Capping Moieties, Lipid PK/PD Moieties, and Linking Groups (wherein ⁀ indicates the point of connection)
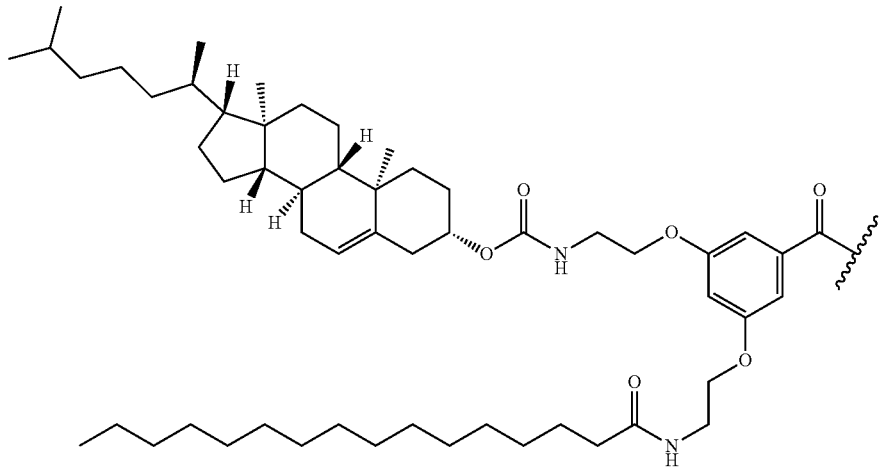 [SMILES: *C(=O)c1cc(OCCNC(=O)CCCCCCCCCCCCCCC)cc(OCCNC(=O)O[C@H]2CC[C@@]3(C)C(=CC[C@H]4[C@@H]5CC[C@H]([C@H](C)CCCC(C)C)[C@@]5(C)CC[C@@H]43)C2)c1]
LP296
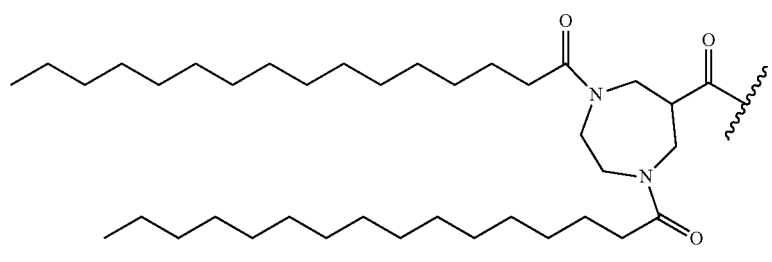 [SMILES: *C(=O)C1CN(C(=O)CCCCCCCCCCCCCCC)CCN(C(=O)CCCCCCCCCCCCCCC)C1]
LP300
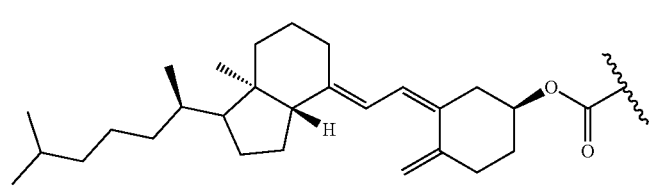 [SMILES: *C(=O)O[C@H]1CCC(=C)/C(=C\C=C2/CCC[C@]3(C)C([C@H](C)CCCC(C)C)CC[C@@H]23)C1]
LP303
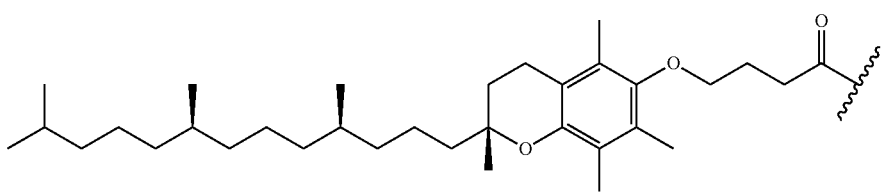 [SMILES: *C(=O)CCCOc1c(C)c(C)c2c(c1C)CC[C@@](C)(CCC[C@H](C)CCC[C@H](C)CCCC(C)C)O2]
LP304
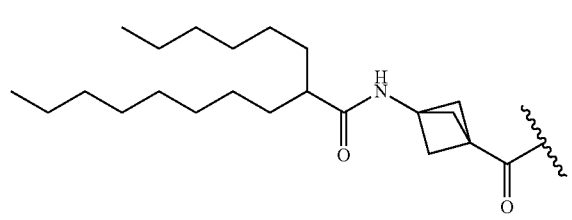 [SMILES: *C(=O)C12CC(NC(=O)C(CCCCCC)CCCCCCCC)(C1)C2]
LP310

TABLE 10-continued
Structures Representing Various Modified Nucleotides, Capping Moieties, Lipid PK/PD Moieties, and Linking Groups (wherein ⌇ indicates the point of connection)
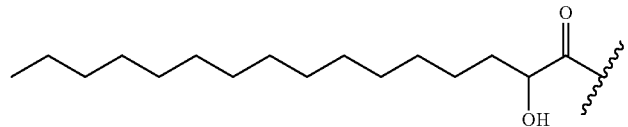 [SMILES: *C(=O)C(O)CCCCCCCCCCCCCC]
LP383
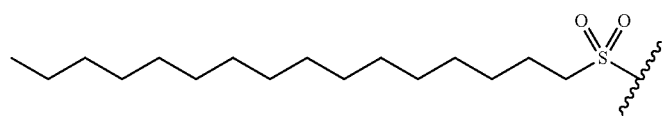 [SMILES: *S(=O)(=O)CCCCCCCCCCCCCCCC]
LP395
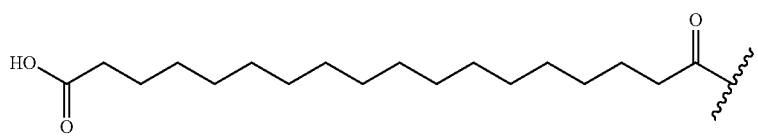 [SMILES: *C(=O)CCCCCCCCCCCCCCCCC(=O)O]
LP396
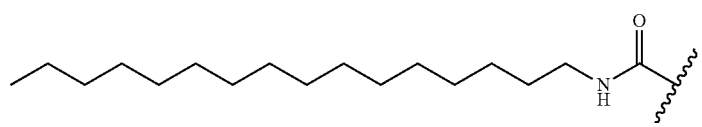 [SMILES: *C(=O)NCCCCCCCCCCCCCCCC]
LP409
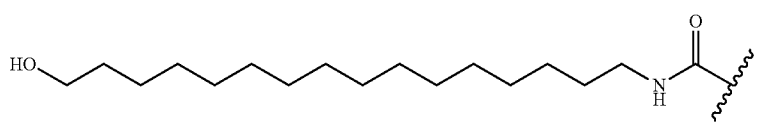 [SMILES: *C(=O)NCCCCCCCCCCCCCCCCO]
LP429
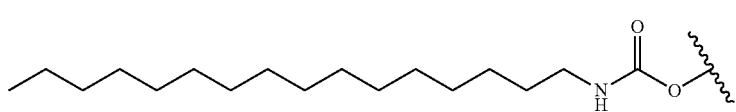 [SMILES: *OC(=O)NCCCCCCCCCCCCCCCC]
LP430
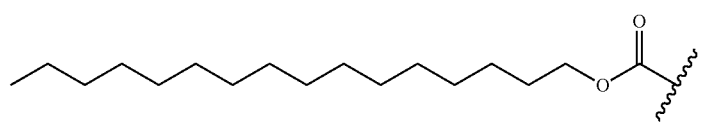
LP431
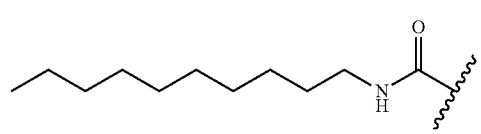 [SMILES: *C(=O)NCCCCCCCCCC]
LP435
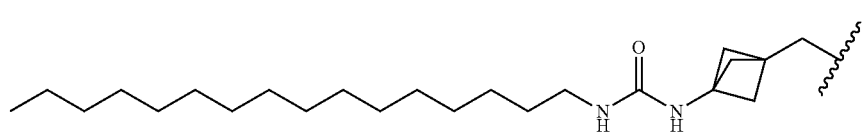 [SMILES: *CC12CC(NC(=O)NCCCCCCCCCCCCCCCC)(C1)C2]
LP439

TABLE 10-continued
Structures Representing Various Modified Nucleotides, Capping Moieties, Lipid
PK/PD Moieties, and Linking Groups (wherein ⁞ indicates the point of connection)
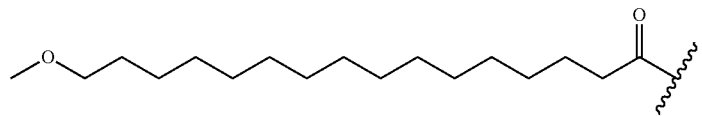
LP440
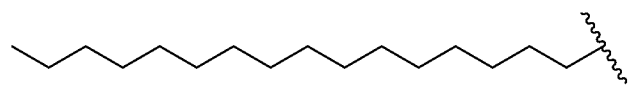 [SMILES: *CCCCCCCCCCCCCCCC]
LP441
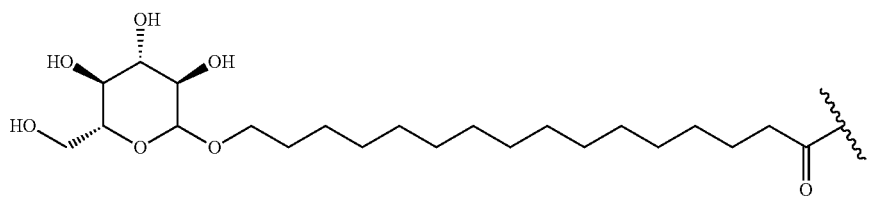 [SMILES: *C(=O)CCCCCCCCCCCCCCCOC1O[C@H](CO)[C@@H](O)[C@H](O)[C@H]1O]
LP456
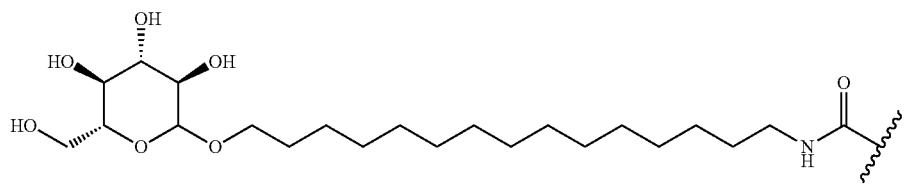 [SMILES: *C(=O)NCCCCCCCCCCCCCCCOC1O[C@H](CO)[C@@H](O)[C@H](O)[C@H]1O]
LP462
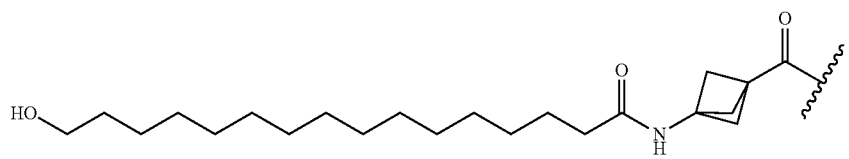 [SMILES: *C(=O)C12CC(NC(=O)CCCCCCCCCCCCCCCO)(C1)C2]
LP463
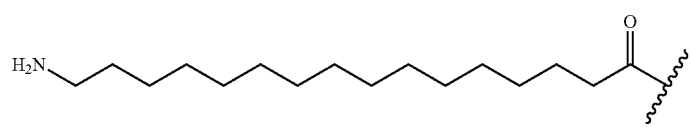 [SMILES: *C(=O)CCCCCCCCCCCCCCCN]
LP464
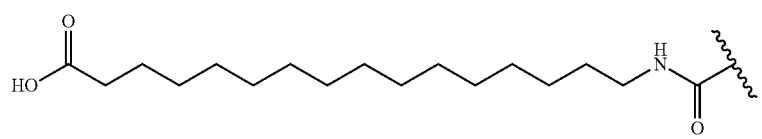 [SMILES: *C(=O)NCCCCCCCCCCCCCCCC(=O)O]
LP465
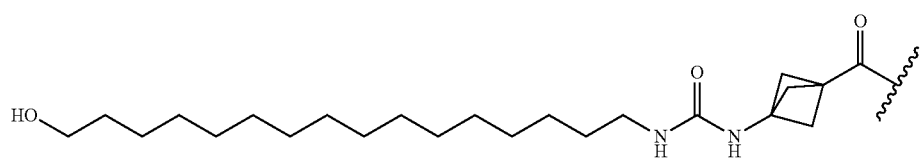 [SMILES: *C(=O)C12CC(NC(=O)NCCCCCCCCCCCCCCCCO)(C1)C2]
LP466

TABLE 10-continued
Structures Representing Various Modified Nucleotides, Capping Moieties, Lipid PK/PD Moieties, and Linking Groups (wherein ⁞ indicates the point of connection)
When positioned internally at 2' position:
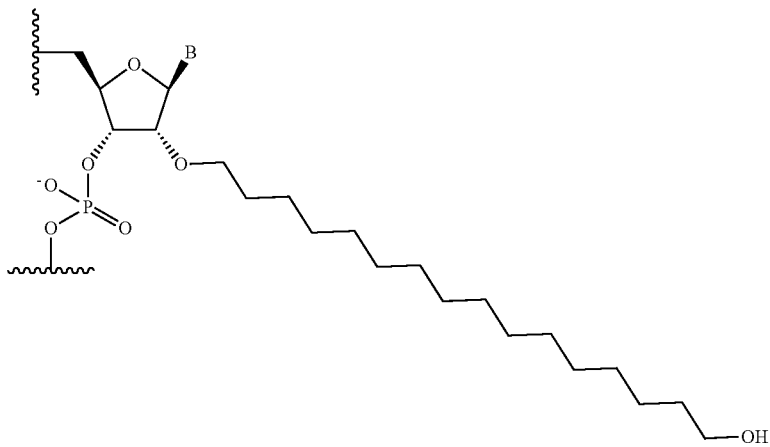
LP493 (wherein B is a nucleobase)
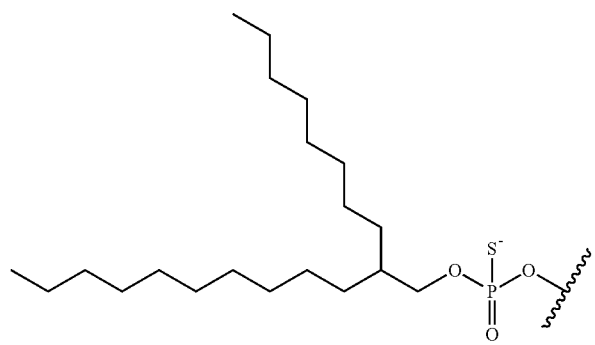
(2C8C12)s
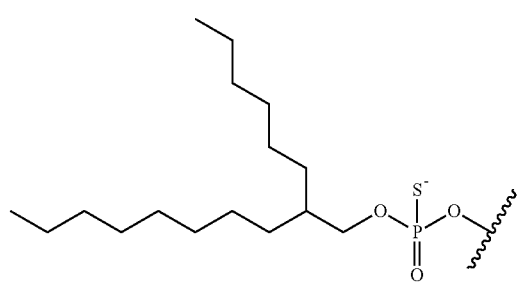
(2C6C10)s
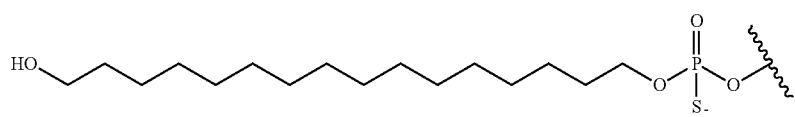
HO-C16s
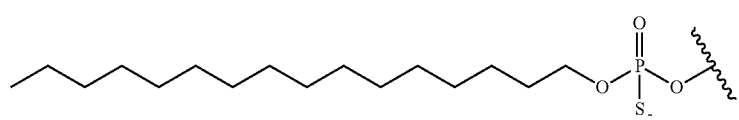
c16s TABLE 10-continued
Structures Representing Various Modified Nucleotides, Capping Moieties, Lipid PK/PD Moieties, and Linking Groups (wherein ⌇ indicates the point of connection)
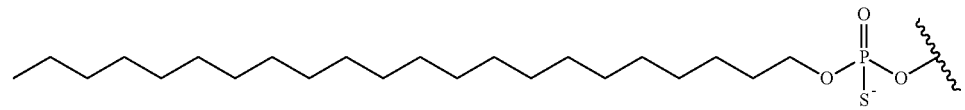
C22s
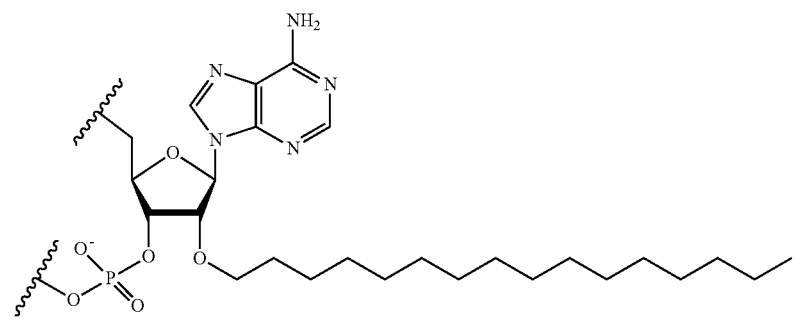
aC16
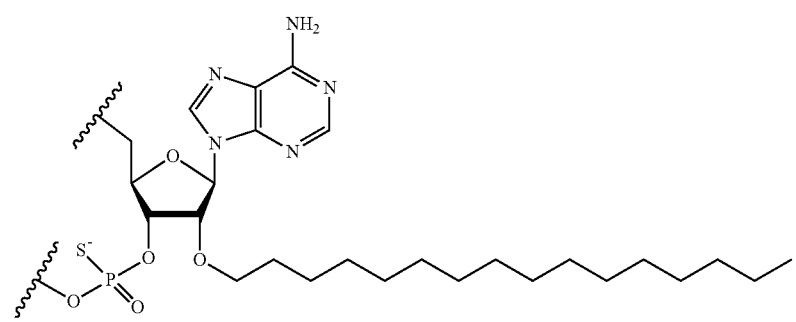
aC16s
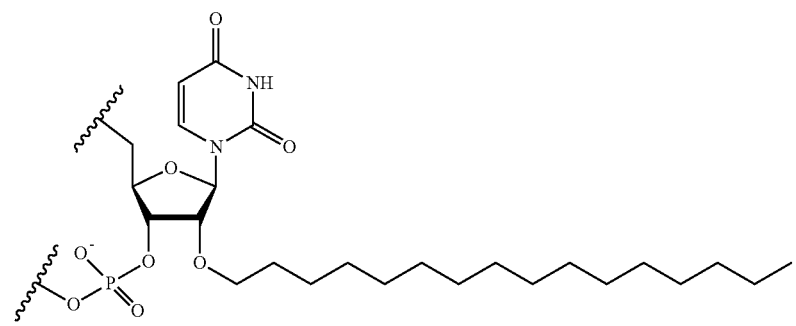
uC16
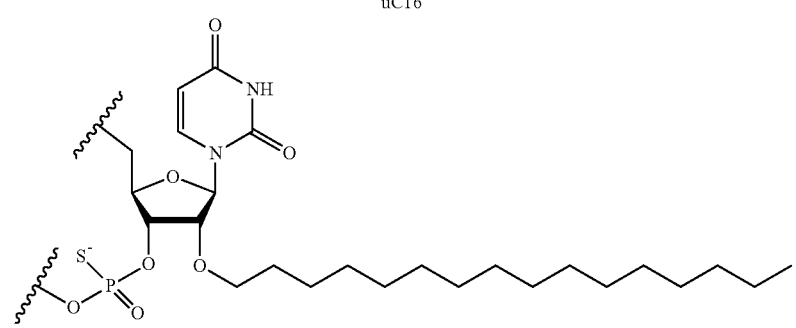
uC16s TABLE 10-continued
Structures Representing Various Modified Nucleotides, Capping Moieties, Lipid PK/PD Moieties, and Linking Groups (wherein ⸹ indicates the point of connection)
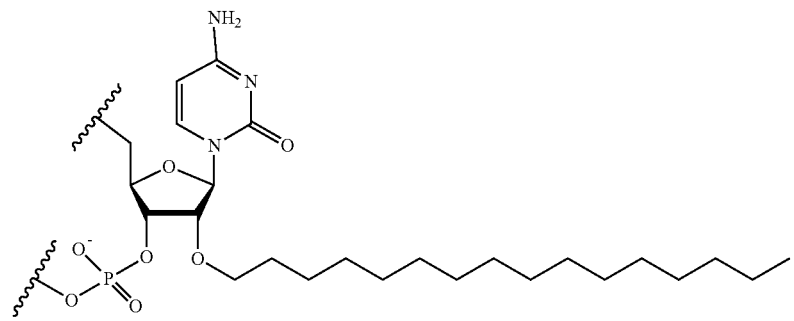
cC16
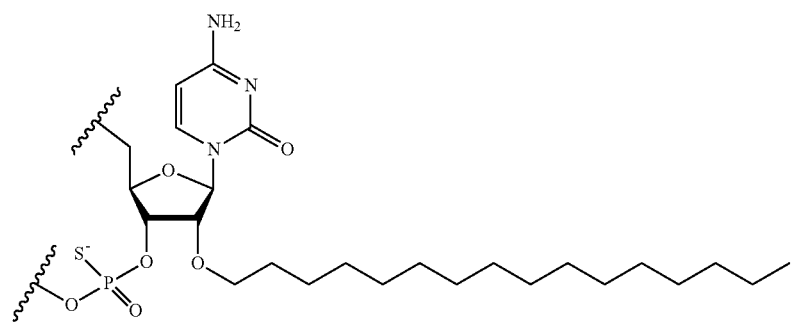
cC16s
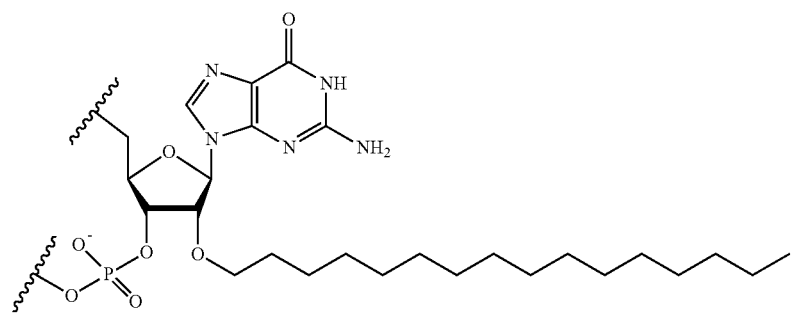
gC16
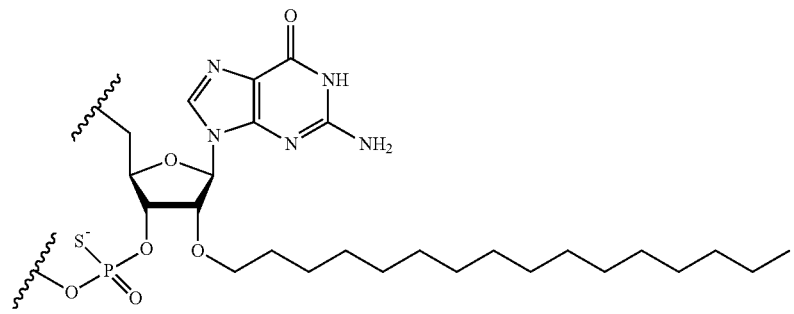
gC16s Alternatively, other linking groups known in the art may be used. In many instances, linking groups can be commercially acquired or alternatively, are incorporated into commercially available nucleotide phosphoramidites. (See, e.g., International Patent Application Publication No. WO 2019/161213, which is incorporated herein by reference in its entirety).

In some embodiments, a MAPT RNAi agent is delivered without being conjugated to an antigen binding protein or other targeting group (referred to as being "naked" or a "naked RNAi agent").

In some embodiments, a MAPT RNAi agent is delivered without being conjugated to a targeting ligand or pharmacokinetic/pharmacodynamic (PK/PD) modulator (referred to as being "naked" or a "naked RNAi agent").

In some embodiments, a MAPT RNAi agent is conjugated to a targeting group, a linking group, a PK modulator, and/or another non-nucleotide group to facilitate delivery of the MAPT RNAi agent to the cell or tissue of choice, for example, to a CNS cell in vivo. In some embodiments, a MAPT RNAi agent is conjugated to an antigen binding protein. In some embodiments, a MAPT RNAi agent is conjugated to a lipid moiety.

In some embodiments, a delivery vehicle may be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine.

In some embodiments, the RNAi agents can be combined with lipids, nanoparticles, polymers, liposomes, micelles, DPCs or other delivery systems available in the art for nucleic acid delivery. The RNAi agents can also be chemically conjugated to targeting groups, lipids (including, but not limited to cholesteryl and cholesteryl derivatives), encapsulating in nanoparticles, liposomes, micelles, conjugating to polymers or DPCs (see, for example WO 2000/053722, WO 2008/022309, WO 2011/104169, and WO 2012/083185, WO 2013/032829, WO 2013/158141, each of which is incorporated herein by reference), by iontophoresis, or by incorporation into other delivery vehicles or systems available in the art such as hydrogels, cyclodextrins, biodegradable nanocapsules, bioadhesive microspheres, or proteinaceous vectors. In some embodiments the RNAi agents can be conjugated to antibodies having affinity for CNS cells. In some embodiments, the RNAi agents can be linked to targeting ligands that have affinity for CNS cells or receptors present on CNS cells.

Antigen Binding Proteins

In one aspect, MAPT RNAi agents are conjugates to antigen binding proteins. In some embodiments, the antigen binding protein may be selected from the group consisting of: an antibody, an antibody fragment (e.g., an antigen binding fragment, or Fab), scFv, or other functional component or derivative of an antibody encompassing a Fab and/or complementary-determining regions (CDRs) disclosed herein.

In some embodiments, the antigen binding protein may act as a shuttle to facilitate the crossing of the blood brain barrier (BBB) of the RNAi agent, such that the RNAi agent may be administered subcutaneously and reach CNS tissue. In some embodiments, the antigen binding protein is an anti-Transferrin 1 (TfR1) antibody or Fab.

In some embodiments, the antigen binding protein is a Fab. In some embodiments, the Fab comprises (i) 6 complementary determining regions (CDRs), (ii) 3 CDRs on the variable light chain (VL), or (iii) 3 CDRs on the variable heavy chain (VH).

In some embodiments, the Fab comprises a light chain and a heavy chain. In some embodiments, the light chain comprises a variable light chain (VL) and a light constant chain 1 (CL). In some embodiments, the VL comprises three CDRs. In some embodiments, the VL comprises a VL CDR1, a VL CDR2, and a VL CDR3. In some embodiments, the heavy chain comprises a variable heavy chain (VH) and a heavy constant chain 1 (CH). In some embodiments, the VH comprises three CDRs. In some embodiments, the VH comprises a VH CDR1, a VH CDR2, and a VH CDR3.

In some embodiments, the light constant chain 1 (CL) comprises or consists of the sequence: RTVAAPSVFIFPPS-DEQLKSGTASVVCLLNNFYPREAKVQWKVD-NALQSGNSQESVT EQDSKDSTYSLSSTLTL-SKADYEKHKVYACEVTHQGLSSPVTKSFNRGEC (SEQ ID NO: 2). In some embodiments, the light chain comprises or consists of the sequence:

```
                                    (SEQ ID NO: 3)
DIQLTQSPSSLSASVGDRVTITCRASDKLYSNLAWYQQKPGKAPK

LLIYDATLLASGVPSRFSGSGSGTDYTLTISSLQPEDFATYYCQH

FWGTPLTFGQGTKVEIKRTVAAPSVFIFPPSDEQLKSGTASVVCL

LNNFYPREAKVQWKVDNALQSGNSQESVTEQDSKDSTYSLSSTLT

LSKADYEKHKVYACEVTHQGLSSPVTKSFNRGEC.
```

In some embodiments, the heavy constant chain 1 (CH) comprises or consists of the sequence: ASTKGPSVF-PLAPSSKSTSGGTAALGCLVKDYF-PEPVTVSWNSGALTSGVHTFPAVL QSSGLYS-LSSVVTVPSSSLGTQTYICNVNHKPSNTKVDKR-VEPKSCDKTH (SEQ ID NO: 4). In some embodiments the heavy chain comprises or consists of the sequence:

```
                                    (SEQ ID NO: 5)
EVQLVESGGGLVQPGGSLRLSCATSGFTFTSYWMHWVRQAPGKGL

EWVAEINPTNGRTNYIEKFKSRITLSVDKSKSTVYLQMNSLRAED

TAVYYCARGTRAYHYWGQGTLVTVSSASTKGPSVFPLAPSSKSTS

GGTAALGCLVKDYFPEPVTVSWNSGALTSGVHTFPAVLQSSGLYS

LSSVVTVPSSSLGTQTYICNVNHKPSNTKVDKRVEPKSCDKTH.
```

In some embodiments, the antigen binding protein may have a VL CDR1 sequence selected from the group consisting of: RASDGLYSNLA (SEQ ID NO: 6), RASDN-LYRNLA (SEQ ID NO: 7), and RASDKLYSNLA (SEQ ID NO: 8).

In some embodiments, the antigen binding protein may have a VL CDR2 sequence selected from the group consisting of: DATLLAS (SEQ ID NO: 9), DARNLAS (SEQ ID NO: 10), DAFNLAS (SEQ ID NO: 11), DATRLAS (SEQ ID NO: 12), DATKLAS (SEQ ID NO: 13), and DAKNLAS (SEQ ID NO: 14).

In some embodiments, the antigen binding protein may have a VL CDR3 sequence of QHFWGTPLT (SEQ ID NO: 15).

In some embodiments, the antigen binding protein may have a VH CDR1 sequence selected from the group consisting of: GYTFNSYWMH (SEQ ID NO: 16), GYTFKSYWMH (SEQ ID NO: 17), GFTFTSYWMH (SEQ ID NO: 18), GYTFTSYWVH (SEQ ID NO: 19), and GYTFTSYWMH (SEQ ID NO: 20).

In some embodiments, the antigen binding protein may have a VH CDR2 sequence selected from the group consisting of: EINPTNGRVNYIEKFKS (SEQ ID NO: 21), EINPTNGRFNYIEKFKS (SEQ ID NO: 22), EINPTNGRTNYIEKFKS (SEQ ID NO: 23), and EINPTNGRSNYIEKFKS (SEQ ID NO: 24).

In some embodiments, the antigen binding protein may have a VH CDR3 sequence of:

```
                                          (SEQ ID NO: 25)
GTRAYHY.
```

In some embodiments, the VL comprises a sequence of any one of the sequences listed in Table A. Each of the Fabs described in Table A may have a light chain constant region that comprises or consists of the sequence:

```
                                          (SEQ ID NO: 2)
RTVAAPSVFIFPPSDEQLKSGTASVVCLLNNFYPREAKVQWKVDN

ALQSGNSQESVTEQDSKDSTYSLSSTLTLSKADYEKHKVYACEVT

HQGLSSPVTKSFNRGEC
```

TABLE A

| | VL chains with CDR mutation combinations in bold. | |
|---|---|---|
| SEQ ID NO. | Fab | VL SEQUENCE |
| 26 | Fab0002 | DIQMTQSPSSLSASVGDRVTITCRASDNLYSNLAWYQQKPGKSPK LLVYDATNLADGVPSRFSGSGSGTDYTLTISSLQPEDFATYYCQHF WGTPLTFGQGTKVEIK |
| 27 | Fab0060 | DIQLTQSPSSLSASVGDRVTITCRASDGLYSNLAWYQQKPGKAPKL LIYDATKLASGVPSRFSGSGSGTDYTLTISSLQPEDFATYYCQHFW GTPLTFGQGTKVEIK |
| 27 | Fab0061 | DIQLTQSPSSLSASVGDRVTITCRASDGLYSNLAWYQQKPGKAPKL LIYDATKLASGVPSRFSGSGSGTDYTLTISSLQPEDFATYYCQHFW GTPLTFGQGTKVEIK |
| 28 | Fab0062 | DIQLTQSPSSLSASVGDRVTITCRASDGLYSNLAWYQQKPGKAPKL LIYDAFNLASGVPSRFSGSGSGTDYTLTISSLQPEDFATYYCQHFW GTPLTFGQGTKVEIK |
| 29 | Fab0063 | DIQLTQSPSSLSASVGDRVTITCRASDGLYSNLAWYQQKPGKAPKL LIYDATRLASGVPSRFSGSGSGTDYTLTISSLQPEDFATYYCQHFW GTPLTFGQGTKVEIK |
| 30 | Fab0064 | DIQLTQSPSSLSASVGDRVTITCRASDGLYSNLAWYQQKPGKAPKL LIYDAKNLASGVPSRFSGSGSGTDYTLTISSLQPEDFATYYCQHFW GTPLTFGQGTKVEIK |
| 31 | Fab0065 | DIQLTQSPSSLSASVGDRVTITCRASDNLYRNLAWYQQKPGKAPK LLIYDATKLASGVPSRFSGSGSGTDYTLTISSLQPEDFATYYCQHF WGTPLTFGQGTKVEIK |
| 28 | Fab0066 | DIQLTQSPSSLSASVGDRVTITCRASDGLYSNLAWYQQKPGKAPKL LIYDAFNLASGVPSRFSGSGSGTDYTLTISSLQPEDFATYYCQHFW GTPLTFGQGTKVEIK |
| 31 | Fab0067 | DIQLTQSPSSLSASVGDRVTITCRASDNLYRNLAWYQQKPGKAPK LLIYDATKLASGVPSRFSGSGSGTDYTLTISSLQPEDFATYYCQHF WGTPLTFGQGTKVEIK |
| 27 | Fab0068 | DIQLTQSPSSLSASVGDRVTITCRASDGLYSNLAWYQQKPGKAPKL LIYDATKLASGVPSRFSGSGSGTDYTLTISSLQPEDFATYYCQHFW GTPLTFGQGTKVEIK |
| 27 | Fab0069 | DIQLTQSPSSLSASVGDRVTITCRASDGLYSNLAWYQQKPGKAPKL LIYDATKLASGVPSRFSGSGSGTDYTLTISSLQPEDFATYYCQHFW GTPLTFGQGTKVEIK |
| 32 | Fab0070 | DIQLTQSPSSLSASVGDRVTITCRASDKLYSNLAWYQQKPGKAPKL LIYDATLLASGVPSRFSGSGSGTDYTLTISSLQPEDFATYYCQHFW GTPLTFGQGTKVEIK |
| 33 | Fab0071 | DIQLTQSPSSLSASVGDRVTITCRASDGLYSNLAWYQQKPGKAPKL LIYDARNLASGVPSRFSGSGSGTDYTLTISSLQPEDFATYYCQHFW GTPLTFGQGTKVEIK |

TABLE A-continued

VL chains with CDR mutation combinations in bold.

| SEQ ID NO. | Fab | VL SEQUENCE |
|---|---|---|
| 34 | Fab0072 | DIQLTQSPSSLSASVGDRVTITCRASDNLYRNLAWYQQKPGKAPK LLIYDARNLASGVPSRFSGSGSGTDYTLTISSLQPEDFATYYCQHF WGTPLTFGQGTKVEIK |
| 31 | Fab0073 | DIQLTQSPSSLSASVGDRVTITCRASDNLYRNLAWYQQKPGKAPK LLIYDATKLASGVPSRFSGSGSGTDYTLTISSLQPEDFATYYCQHF WGTPLTFGQGTKVEIK |
| 30 | Fab0074 | DIQLTQSPSSLSASVGDRVTITCRASDGLYSNLAWYQQKPGKAPKL LIYDAKNLASGVPSRFSGSGSGTDYTLTISSLQPEDFATYYCQHFW GTPLTFGQGTKVEIK |

In some embodiments, the VL comprises a sequence of any one of the sequences listed in Table B. Each of the Fabs described in Table B may have a heavy chain constant region that comprises or consist of the sequence:

(SEQ ID NO: 4)
ASTKGPSVFPLAPSSKSTSGGTAALGCLVKDYFPEPVTVSWNS

GALTSGVHTFPAVLQSSGLYSLSSVVTVPSSSLGTQTYICNVN

HKPSNTKVDKRVEPKSCDKTH.

TABLE B

VH chains with CDR mutation combinations in bold.

| SEQ ID NO. | Fab | VH SEQUENCE |
|---|---|---|
| 35 | Fab0002 | EVQLVQSGAEVKKPGASVKVSCKASGYTFTSYWMHWVRQAPGQ RLEWIGEINPTNGRTNYIEKFKSRATLTVDKSASTAYMELSSLRSE DTAVYYCARGTRAYHYWGQGTMVTVSS |
| 36 | Fab0060 | EVQLVESGGGLVQPGGSLRLSCATSGYTFTSYWVHWVRQAPGK GLEWVAEINPTNGRTNYIEKFKSRITLSVDKSKSTVYLQMNSLRA EDTAVYYCARGTRAYHYWGQGTLVTVSS |
| 37 | Fab0061 | EVQLVESGGGLVQPGGSLRLSCATSGYTFTSYWMHWVRQAPGK GLEWVAEINPTNGRVNYIEKFKSRITLSVDKSKSTVYLQMNSLRA EDTAVYYCARGTRAYHYWGQGTLVTVSS |
| 37 | Fab0062 | EVQLVESGGGLVQPGGSLRLSCATSGYTFTSYWMHWVRQAPGK GLEWVAEINPTNGRVNYIEKFKSRITLSVDKSKSTVYLQMNSLRA EDTAVYYCARGTRAYHYWGQGTLVTVSS |
| 37 | Fab0063 | EVQLVESGGGLVQPGGSLRLSCATSGYTFTSYWMHWVRQAPGK GLEWVAEINPTNGRVNYIEKFKSRITLSVDKSKSTVYLQMNSLRA EDTAVYYCARGTRAYHYWGQGTLVTVSS |
| 37 | Fab0064 | EVQLVESGGGLVQPGGSLRLSCATSGYTFTSYWMHWVRQAPGK GLEWVAEINPTNGRVNYIEKFKSRITLSVDKSKSTVYLQMNSLRA EDTAVYYCARGTRAYHYWGQGTLVTVSS |
| 38 | Fab0065 | EVQLVESGGGLVQPGGSLRLSCATSGYTFTSYWVHWVRQAPGK GLEWVAEINPTNGRSNYIEKFKSRITLSVDKSKSTVYLQMNSLRA EDTAVYYCARGTRAYHYWGQGTLVTVSS |
| 39 | Fab0066 | EVQLVESGGGLVQPGGSLRLSCATSGYTFTSYWVHWVRQAPGK GLEWVAEINPTNGRVNYIEKFKSRITLSVDKSKSTVYLQMNSLRA EDTAVYYCARGTRAYHYWGQGTLVTVSS |
| 36 | Fab0067 | EVQLVESGGGLVQPGGSLRLSCATSGYTFTSYWVHWVRQAPGK GLEWVAEINPTNGRTNYIEKFKSRITLSVDKSKSTVYLQMNSLRA EDTAVYYCARGTRAYHYWGQGTLVTVSS |

TABLE B-continued

VH chains with CDR mutation combinations in bold.

| SEQ ID NO. | Fab | VH SEQUENCE |
|---|---|---|
| 39 | Fab0068 | EVQLVESGGGLVQPGGSLRLSCATSGYTFTSYWVHWVRQAPGK GLEWVAEINPTNGRVNYIEKFKSRITLSVDKSKSTVYLQMNSLRA EDTAVYYCARGTRAYHYWGQGTLVTVSS |
| 38 | Fab0069 | EVQLVESGGGLVQPGGSLRLSCATSGYTFTSYWVHWVRQAPGK GLEWVAEINPTNGRSNYIEKFKSRITLSVDKSKSTVYLQMNSLRA EDTAVYYCARGTRAYHYWGQGTLVTVSS |
| 40 | Fab0070 | EVQLVESGGGLVQPGGSLRLSCATSGFTFTSYWMHWVRQAPGK GLEWVAEINPTNGRTNYIEKFKSRITLSVDKSKSTVYLQMNSLRA EDTAVYYCARGTRAYHYWGQGTLVTVSS |
| 41 | Fab0071 | EVQLVESGGGLVQPGGSLRLSCATSGYTFNSYWMHWVRQAPGK GLEWVAEINPTNGRTNYIEKFKSRITLSVDKSKSTVYLQMNSLRA EDTAVYYCARGTRAYHYWGQGTLVTVSS |
| 42 | Fab0072 | EVQLVESGGGLVQPGGSLRLSCATSGYTFNSYWMHWVRQAPGK GLEWVAEINPTNGRFNYIEKFKSRITLSVDKSKSTVYLQMNSLRA EDTAVYYCARGTRAYHYWGQGTLVTVSS |
| 43 | Fab0073 | EVQLVESGGGLVQPGGSLRLSCATSGYTFKSYWMHWVRQAPGK GLEWVAEINPTNGRTNYIEKFKSRITLSVDKSKSTVYLQMNSLRA EDTAVYYCARGTRAYHYWGQGTLVTVSS |
| 43 | Fab0074 | EVQLVESGGGLVQPGGSLRLSCATSGYTFKSYWMHWVRQAPGK GLEWVAEINPTNGRTNYIEKFKSRITLSVDKSKSTVYLQMNSLRA EDTAVYYCARGTRAYHYWGQGTLVTVSS |

Tables C-H show the CDR1, CDR2, and CDR3 variants from VL and VH with the combined beneficial mutations.

TABLE C

VL CDR1 variant

| SEQ ID NO: | Fab | CDR1 |
|---|---|---|
| 6 | Fab0060 | RASDGLYSNLA |
| 6 | Fab0061 | RASDGLYSNLA |
| 6 | Fab0062 | RASDGLYSNLA |
| 6 | Fab0063 | RASDGLYSNLA |
| 6 | Fab0064 | RASDGLYSNLA |
| 7 | Fab0065 | RASDNLYRNLA |
| 6 | Fab0066 | RASDGLYSNLA |
| 7 | Fab0067 | RASDNLYRNLA |
| 6 | Fab0068 | RASDGLYSNLA |
| 6 | Fab0069 | RASDGLYSNLA |
| 8 | Fab0070 | RASDKLYSNLA |
| 6 | Fab0071 | RASDGLYSNLA |
| 7 | Fab0072 | RASDNLYRNLA |
| 7 | Fab0073 | RASDNLYRNLA |
| 6 | Fab0074 | RASDGLYSNLA |

TABLE D

VL CDR2 variants

| SEQ ID NO: | Fab | CDR2 |
|---|---|---|
| 13 | Fab0060 | DATKLAS |
| 13 | Fab0061 | DATKLAS |
| 11 | Fab0062 | DAFNLAS |
| 12 | Fab0063 | DATRLAS |
| 14 | Fab0064 | DAKNLAS |
| 13 | Fab0065 | DATKLAS |
| 11 | Fab0066 | DAFNLAS |
| 13 | Fab0067 | DATKLAS |
| 13 | Fab0068 | DATKLAS |
| 13 | Fab0069 | DATKLAS |
| 9 | Fab0070 | DATLLAS |
| 10 | Fab0071 | DARNLAS |
| 10 | Fab0072 | DARNLAS |
| 13 | Fab0073 | DATKLAS |
| 14 | Fab0074 | DAKNLAS |

TABLE E

VL CDR3 variant

| SEQ ID NO: | Fab | CDR3 |
|---|---|---|
| 15 | Fab0060 | QHFWGTPLT |
| 15 | Fab0061 | QHFWGTPLT |
| 15 | Fab0062 | QHFWGTPLT |
| 15 | Fab0063 | QHFWGTPLT |
| 15 | Fab0064 | QHFWGTPLT |
| 15 | Fab0065 | QHFWGTPLT |
| 15 | Fab0066 | QHFWGTPLT |
| 15 | Fab0067 | QHFWGTPLT |
| 15 | Fab0068 | QHFWGTPLT |
| 15 | Fab0069 | QHFWGTPLT |
| 15 | Fab0070 | QHFWGTPLT |
| 15 | Fab0071 | QHFWGTPLT |
| 15 | Fab0072 | QHFWGTPLT |
| 15 | Fab0073 | QHFWGTPLT |
| 15 | Fab0074 | QHFWGTPLT |

TABLE F

VH CDR1 variants

| SEQ ID NO: | Fab | CDR1 |
|---|---|---|
| 19 | Fab0060 | GYTFTSYWVH |
| 20 | Fab0061 | GYTFTSYWMH |
| 20 | Fab0062 | GYTFTSYWMH |
| 20 | Fab0063 | GYTFTSYWMH |
| 20 | Fab0064 | GYTFTSYWMH |
| 19 | Fab0065 | GYTFTSYWVH |
| 19 | Fab0066 | GYTFTSYWVH |
| 19 | Fab0067 | GYTFTSYWVH |
| 19 | Fab0068 | GYTFTSYWVH |
| 19 | Fab0069 | GYTFTSYWVH |
| 18 | Fab0070 | GFTFTSYWMH |
| 16 | Fab0071 | GYTFNSYWMH |
| 16 | Fab0072 | GYTFNSYWMH |
| 17 | Fab0073 | GYTFKSYWMH |
| 17 | Fab0074 | GYTFKSYWMH |

TABLE G

VH CDR2 variants

| SEQ ID NO: | Fab | CDR2 |
|---|---|---|
| 23 | Fab0060 | EINPTNGRTNYIEKFKS |
| 21 | Fab0061 | EINPTNGRVNYIEKFKS |
| 21 | Fab0062 | EINPTNGRVNYIEKFKS |
| 21 | Fab0063 | EINPTNGRVNYIEKFKS |
| 21 | Fab0064 | EINPTNGRVNYIEKFKS |
| 24 | Fab0065 | EINPTNGRSNYIEKFKS |
| 21 | Fab0066 | EINPTNGRVNYIEKFKS |
| 23 | Fab0067 | EINPTNGRTNYIEKFKS |
| 21 | Fab0068 | EINPTNGRVNYIEKFKS |
| 24 | Fab0069 | EINPTNGRSNYIEKFKS |
| 23 | Fab0070 | EINPTNGRTNYIEKFKS |
| 23 | Fab0071 | EINPTNGRTNYIEKFKS |
| 22 | Fab0072 | EINPTNGRFNYIEKFKS |
| 23 | Fab0073 | EINPTNGRTNYIEKFKS |
| 23 | Fab0074 | EINPTNGRTNYIEKFKS |

TABLE H

VH CDR3 variants

| SEQ ID NO: | Fab | CDR3 |
|---|---|---|
| 25 | Fab0060 | GTRAYHY |
| 25 | Fab0061 | GTRAYHY |
| 25 | Fab0062 | GTRAYHY |
| 25 | Fab0063 | GTRAYHY |
| 25 | Fab0064 | GTRAYHY |
| 25 | Fab0065 | GTRAYHY |
| 25 | Fab0066 | GTRAYHY |
| 25 | Fab0067 | GTRAYHY |
| 25 | Fab0068 | GTRAYHY |
| 25 | Fab0069 | GTRAYHY |
| 25 | Fab0070 | GTRAYHY |
| 25 | Fab0071 | GTRAYHY |
| 25 | Fab0072 | GTRAYHY |
| 25 | Fab0073 | GTRAYHY |
| 25 | Fab0074 | GTRAYHY |

In some embodiments, the Fab binds TfR1. In some embodiments, the Fab binds TfR1 with an affinity of at least about 1, 2, 3, 4, 5, 6, 7, 8, 9, 10, 20, 30, 40, 50, 60, 70, 80, 90, 100 nM. In some embodiments, the Fab binds TfR1 with an affinity of about 1, 2, 3, 4, 5, 6, 7, 8, 9, 10, 20, 30, 40, 50, 60, 70, 80, 90, 100 nM. In some embodiments, the Fab binds TfR1 with an affinity of at least about 1 nM. In some embodiments, the Fab binds TfR1 with a KD value of at least about 1, 2, 3, 4, 5, 6, 7, 8, 9, 10, 20, 30, 40, 50, 60, 70, 80, 90, 100 nM. In some embodiments, the Fab binds TfR1 with a KD value of about 1, 2, 3, 4, 5, 6, 7, 8, 9, 10, 20, 30, 40, 50, 60, 70, 80, 90, 100 nM. In some embodiments, the Fab binds TfR1 with a KD value of at least about 1 nM.

In some embodiments, the Fab is conjugated to an RNAi agent disclosed herein. In some embodiments, the RNAi agent is conjugated to the Fab using a covalent or non-covalent bond, ionic bond, hydrogen bond, hydrophobic interaction, peptide, polymer, or a nucleic acid binding protein. In some embodiments, the RNAi agent is conjugated to the Fab using a covalent bond. In some embodiments, the RNAi agent is conjugated to the Fab via a lysine residue or a cysteine residue. In some embodiments, the RNAi agent is conjugated to the Fab via a lysine residue. In some embodiments, the RNAi agent is conjugated to the Fab via a cysteine residue. In some embodiments, the RNAi agent is conjugated to the Fab in a site-specific manner. In some embodiments, the RNAi agent is conjugated to the Fab in a non-site-specific manner.

In some embodiments, the RNAi agent is conjugated to the Fab at the 5' terminus or the 3' terminus of the RNAi agent. In some embodiments, the RNAi agent is conjugated to the Fab at the 5' terminus of the RNAi agent. In some embodiments, the RNAi agent is conjugated to the Fab at the 3' terminus of the RNAi agent. In some embodiments, the RNAi agent is conjugated to the Fab at the 5' terminus or the 3' terminus of the sense strand of the RNAi agent. In some embodiments, the RNAi agent is conjugated to the Fab at the 5' terminus of the sense strand of the RNAi agent. In some embodiments, the RNAi agent is conjugated to the Fab at the 3' terminus of the sense strand of the RNAi agent.

Pharmaceutical Compositions and Formulations

The MAPT RNAi agents disclosed herein can be prepared as pharmaceutical compositions or formulations (also referred to herein as "medicaments"). In some embodiments, pharmaceutical compositions include at least one MAPT RNAi agent. These pharmaceutical compositions are particularly useful in the inhibition of the expression of MAPT mRNA in a target cell, a group of cells, a tissue, or an organism. The pharmaceutical compositions can be used to treat a subject having a disease, disorder, or condition that would benefit from reduction in the level of the target mRNA, or inhibition in expression of the target gene. The pharmaceutical compositions can be used to treat a subject at risk of developing a disease or disorder that would benefit from reduction of the level of the target mRNA or an inhibition in expression the target gene. In one embodiment, the method includes administering a MAPT RNAi agent linked to an antigen binding protein as described herein, to a subject to be treated. In some embodiments, one or more pharmaceutically acceptable excipients (including vehicles, carriers, diluents, and/or delivery polymers) are added to the pharmaceutical compositions that include a MAPT RNAi agent, thereby forming a pharmaceutical formulation or medicament suitable for in vivo delivery to a subject, including a human.

The MAPT RNAi agents disclosed herein can be prepared as pharmaceutical compositions or formulations (also referred to herein as "medicaments"). In some embodiments, pharmaceutical compositions include at least one MAPT RNAi agent. These pharmaceutical compositions are particularly useful in the inhibition of the expression of MAPT mRNA in a target cell, a group of cells, a tissue, or an organism. The pharmaceutical compositions can be used to treat a subject having a disease, disorder, or condition that would benefit from reduction in the level of the target mRNA, or inhibition in expression of the target gene. The pharmaceutical compositions can be used to treat a subject at risk of developing a disease or disorder that would benefit from reduction of the level of the target mRNA or an inhibition in expression the target gene. In one embodiment, the method includes administering a MAPT RNAi agent linked to a PK/PD modulator as described herein, to a subject to be treated. In some embodiments, one or more pharmaceutically acceptable excipients (including vehicles, carriers, diluents, and/or delivery polymers) are added to the pharmaceutical compositions that include a MAPT RNAi agent, thereby forming a pharmaceutical formulation or medicament suitable for in vivo delivery to a subject, including a human.

The pharmaceutical compositions that include a MAPT RNAi agent and methods disclosed herein decrease the level of the target mRNA in a cell, group of cells, tissue, organ, or subject, including by administering to the subject a therapeutically effective amount of a herein described MAPT RNAi agent, thereby inhibiting the expression of MAPT mRNA in the subject. In some embodiments, the subject has been previously identified or diagnosed as having a disease or disorder that can be mediated at least in part by a reduction in MAPT gene expression. In some embodiments, the subject has been previously diagnosed with having one or more neurodegenerative diseases such as Alzheimer's disease, Frontotemporal lobar degeneration dementia (FTLD), Progressive supranuclear palsy, and other tauopathies. In some embodiments the neurodegenerative disease is Alzheimer's Disease.

In some embodiments the subject has been previously diagnosed with having neurodegenerative disease.

Embodiments of the present disclosure include pharmaceutical compositions for delivering a MAPT RNAi agent to a CNS cell in vivo. Such pharmaceutical compositions can include, for example, a MAPT RNAi agent conjugated to an antigen binding protein. In other embodiments, a pharmaceutical composition can include a MAPT RNAi agent conjugated to a lipid moiety.

In some embodiments, the described pharmaceutical compositions including a MAPT RNAi agent are used for treating or managing clinical presentations in a subject that would benefit from the inhibition of expression of MAPT. In some embodiments, a therapeutically or prophylactically effective amount of one or more of pharmaceutical compositions is administered to a subject in need of such treatment. In some embodiments, administration of any of the disclosed MAPT RNAi agents can be used to decrease the number, severity, and/or frequency of symptoms of a disease in a subject.

In some embodiments, the described MAPT RNAi agents are optionally combined with one or more additional (i.e., second, third, etc.) therapeutics. A second therapeutic can be another MAPT RNAi agent (e.g., a MAPT RNAi agent that targets a different sequence within a MAPT gene). In some embodiments, a second therapeutic can be an RNAi agent that targets the MAPT gene. An additional therapeutic can also be a small molecule drug, antibody, antibody fragment, and/or aptamer. The MAPT RNAi agents, with or without the one or more additional therapeutics, can be combined with one or more excipients to form pharmaceutical compositions.

The described pharmaceutical compositions that include a MAPT RNAi agent can be used to treat at least one symptom in a subject having a disease or disorder that would benefit from reduction or inhibition in expression of MAPT mRNA.

In some embodiments, the subject is administered a therapeutically effective amount of one or more pharmaceutical compositions that include a MAPT RNAi agent thereby treating the symptom. In other embodiments, the subject is administered a prophylactically effective amount of one or more MAPT RNAi agents, thereby preventing or inhibiting the at least one symptom.

In some embodiments, one or more of the described MAPT RNAi agents are administered to a mammal in a pharmaceutically acceptable carrier or diluent. In some embodiments, the mammal is a human.

The route of administration is the path by which a MAPT RNAi agent is brought into contact with the body. In general, methods of administering drugs, oligonucleotides, and nucleic acids including the CNS, for treatment of a mammal are well known in the art and can be applied to administration of the compositions described herein. The MAPT RNAi agents disclosed herein can be administered via any suitable route in a preparation appropriately tailored to the particular route. Thus, in some embodiments, the herein described pharmaceutical compositions are administered via inhalation, intranasal administration, intratracheal administration, or oropharyngeal aspiration administration. In some embodiments, the pharmaceutical compositions can be administered by injection, for example, intravenously, intramuscularly, intracutaneously, subcutaneously, intracerebroventricularly, intraarticularly, intraocularly, or intraperitoneally, or topically.

The pharmaceutical compositions including a MAPT RNAi agent described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with the compositions described herein. For example, delivery can be by local administration, (e.g., direct injection, implantation, or topical administering), systemic administration, or subcutaneous, intravenous, intraperitoneal, or parenteral routes, including intracranial (e.g., intraventricular, intraparenchymal and intrathecal), intracerebroventricular, intramuscular, transdermal, airway (aerosol), nasal, oral, rectal, or topical (including buccal and sublingual) administration. In some embodiments, the compositions are administered via inhalation, intranasal administration, oropharyngeal aspiration administration, or intratracheal administration. For example, in some embodiments, it is desired that the MAPT RNAi agents described herein inhibit the expression of a MAPT gene in the CNS.

In some embodiments, the pharmaceutical compositions described herein comprise one or more pharmaceutically acceptable excipients. The pharmaceutical compositions described herein are formulated for administration to a subject.

As used herein, a pharmaceutical composition or medicament includes a pharmacologically effective amount of at least one of the described therapeutic compounds and one or more pharmaceutically acceptable excipients. Pharmaceutically acceptable excipients (excipients) are substances other than the Active Pharmaceutical Ingredient (API, therapeutic product, e.g., MAPT RNAi agent) that are intentionally included in the drug delivery system. Excipients do not exert or are not intended to exert a therapeutic effect at the intended dosage. Excipients can act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, buffering agents, carriers, coating agents, colors, delivery enhancers, delivery polymers, detergents, dextran, dextrose, diluents, disintegrants, emulsifiers, extenders, fillers, flavors, glidants, humectants, lubricants, oils, polymers, preservatives, saline, salts, solvents, sugars, surfactants, suspending agents, sustained release matrices, sweeteners, thickening agents, tonicity agents, vehicles, water-repelling agents, and wetting agents.

Pharmaceutical compositions suitable for injectable use include sterile aqueous solutions (where water-soluble) or dispersions and sterile powders for the extemporaneous preparation of sterile injectable solutions or dispersion. For intravenous administration, suitable carriers include physiological saline, bacteriostatic water, Cremophor® EL™ (BASF, Parsippany, NJ) or phosphate buffered saline (PBS). It should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyethylene glycol), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filter sterilization. Generally, dispersions are prepared by incorporating the active compound into a sterile vehicle which contains a basic dispersion medium and the required other ingredients from those enumerated above. In the case of sterile powders for the preparation of sterile injectable solutions, methods of preparation include vacuum drying and freeze-drying which yields a powder of the active ingredient plus any additional desired ingredient from a previously sterile-filtered solution thereof.

Formulations suitable for intra-articular administration can be in the form of a sterile aqueous preparation of the drug that can be in microcrystalline form, for example, in the form of an aqueous microcrystalline suspension. Liposomal formulations or biodegradable polymer systems can also be used to present the drug for both intra-articular and ophthalmic administration.

The active compounds can be prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Liposomal suspensions can also be used as pharmaceutically acceptable carriers. These can be prepared according to methods known to those skilled in the art, for example, as described in U.S. Pat. No. 4,522,811.

The MAPT RNAi agents can be formulated in compositions in dosage unit form for ease of administration and uniformity of dosage. Dosage unit form refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the therapeutic effect to be achieved, and the limitations inherent in the art of compounding such an active compound for the treatment of individuals.

A pharmaceutical composition can contain other additional components commonly found in pharmaceutical compositions. Such additional components include, but are not limited to: anti-pruritics, astringents, local anesthetics, or anti-inflammatory agents (e.g., antihistamine, diphenhydramine, etc.). It is also envisioned that cells, tissues, or isolated organs that express or comprise the herein defined RNAi agents may be used as "pharmaceutical compositions." As used herein, "pharmacologically effective amount," "therapeutically effective amount," or simply "effective amount" refers to that amount of an RNAi agent to produce a pharmacological, therapeutic, or preventive result.

In some embodiments, MAPT RNAi agent pharmaceutical compositions may contain salts such as sodium chloride, calcium chloride, magnesium chloride, potassium chloride, sodium phosphate dibasic, sodium phosphate monobasic, or combinations thereof.

In some embodiments, the methods disclosed herein further comprise the step of administering a second therapeutic or treatment in addition to administering an RNAi agent disclosed herein. In some embodiments, the second therapeutic is another MAPT RNAi agent (e.g., a MAPT RNAi agent that targets a different sequence within the MAPT target). In other embodiments, the second therapeutic can be a small molecule drug, an antibody, an antibody fragment, and/or an aptamer.

In some embodiments, described herein are compositions that include a combination or cocktail of at least two MAPT RNAi agents having different sequences. In some embodiments, the two or more MAPT RNAi agents are each separately and independently linked to antigen binding proteins. In some embodiments, the two or more MAPT RNAi agents are each separately and independently linked to lipids.

Described herein are compositions for delivery of MAPT RNAi agents to central nervous system (CNS) cells. Furthermore, compositions for delivery of MAPT RNAi agents to cells, including neurons, astrocytes, microglia and endothelial cells, in vivo, are generally described herein.

Generally, an effective amount of a MAPT RNAi agent disclosed herein will be in the range of from about 0.0001 to about 20 mg/kg of body weight dose, e.g., from about 0.001 to about 5 mg/kg of body weight dose. In some embodiments, an effective amount of a MAPT RNAi agent will be in the range of from about 0.01 mg/kg to about 3.0 mg/kg of body weight per dose. In some embodiments, an effective amount of a MAPT RNAi agent will be in the range of from about 0.03 mg/kg to about 2.0 mg/kg of body weight per dose. In some embodiments, an effective amount of a MAPT RNAi agent will be in the range of from about 0.01 to about 1.0 mg/kg. In some embodiments, an effective amount of a MAPT RNAi agent will be in the range of from about 0.50 to about 1.0 mg/kg. In some embodiments, a fixed dose of MAPT RNAi agent is administered to the subject. In some embodiments the dose administered to the human subject is between about 1.0 mg and about 750 mg. In some embodiments, the dose of MAPT RNAi agent administered to the human subject is between about 10 mg and about 450 mg. In some embodiments, the dose of MAPT RNAi agent administered to the human subject is between about 25 mg and about 450 mg. In some embodiments, the dose of MAPT RNAi agent administered to the human subject is about 50 mg, about 75 mg, about 100 mg, about 150 mg, about 200 mg, about 250 mg, about 300 mg, about 350 mg, about 400 mg, or about 450 mg. The amount administered will also likely depend on such variables as the overall health status of the patient, the relative biological efficacy of the compound delivered, the formulation of the drug, the presence and types of excipients in the formulation, and the route of administration. Also, it is to be understood that the initial dosage administered can be increased beyond the above upper level to rapidly achieve the desired blood-level or tissue level, or the initial dosage can be smaller than the optimum. In some embodiments, a dose is administered daily. In some embodiments, a dose is administered weekly. In further embodiments, a dose is administered bi-weekly, tri-weekly, once monthly, or once quarterly (i.e., once every three months).

For treatment of disease or for formation of a medicament or composition for treatment of a disease, the pharmaceutical compositions described herein including a MAPT RNAi agent can be combined with an excipient or with a second therapeutic agent or treatment including, but not limited to: a second or other RNAi agent, a small molecule drug, an antibody, an antibody fragment, peptide, and/or an aptamer.

The described MAPT RNAi agents, when added to pharmaceutically acceptable excipients or adjuvants, can be packaged into kits, containers, packs, or dispensers.

Methods of Treatment and Inhibition of MAPT Gene Expression

The MAPT RNAi agents disclosed herein can be used to treat a subject (e.g., a human or other mammal) having a disease or disorder that would benefit from administration of the RNAi agent. In some embodiments, the RNAi agents disclosed herein can be used to treat a subject (e.g., a human) that would benefit from a reduction and/or inhibition in expression of MAPT mRNA and/or a reduction in MAPT protein.

In some embodiments, the RNAi agents disclosed herein can be used to treat a subject (e.g., a human) having a disease or disorder for which the subject would benefit from reduction in MAPT protein, including but not limited to, Alzheimer's disease, Frontotemporal lobar degeneration dementia (FTLD), Progressive supranuclear palsy, and other tauopathies. Treatment of a subject can include therapeutic and/or prophylactic treatment. The subject is administered a therapeutically effective amount of any one or more MAPT RNAi agents described herein. The subject can be a human, patient, or human patient. The subject may be an adult, adolescent, child, or infant. Administration of a pharmaceutical composition described herein can be to a human being or animal.

Mutant MAPT activity is known to promote neurodegenerative disorders. In some embodiments, the described MAPT RNAi agents are used to treat at least one symptom mediated at least in part by a reduction in mutant MAPT protein levels, in a subject. The subject is administered a therapeutically effective amount of any one or more of the described MAPT RNAi agents. In some embodiments, the subject is administered a prophylactically effective amount of any one or more of the described RNAi agents, thereby treating the subject by preventing or inhibiting the at least one symptom.

In certain embodiments, the present disclosure provides methods for treatment of diseases, disorders, conditions, or pathological states mediated at least in part by MAPT gene expression, in a patient in need thereof, wherein the methods include administering to the patient any of the MAPT RNAi agents described herein.

In some embodiments, the MAPT RNAi agents are used to treat or manage a clinical presentation or pathological state in a subject, wherein the clinical presentation or pathological state is mediated at least in part by a reduction in MAPT gene expression. The subject is administered a therapeutically effective amount of one or more of the MAPT RNAi agents or MAPT RNAi agent-containing compositions described herein. In some embodiments, the method comprises administering a composition comprising a MAPT RNAi agent described herein to a subject to be treated.

In a further aspect, the disclosure features methods of treatment (including prophylactic or preventative treatment) of diseases or symptoms that may be addressed by a reduction in MAPT protein levels, the methods comprising administering to a subject in need thereof a MAPT RNAi agent that includes an antisense strand comprising the sequence of any of the sequences in Table 2, Table 3, or Table 9. Also described herein are compositions for use in such methods.

The described MAPT RNAi agents and/or compositions that include MAPT RNAi agents can be used in methods for therapeutic treatment of disease or conditions caused by enhanced or elevated MAPT protein levels. Such methods include administration of a MAPT RNAi agent as described herein to a subject, e.g., a human or animal subject.

In another aspect, the disclosure provides methods for the treatment (including prophylactic treatment) of a pathological state (such as a condition or disease) mediated at least in part by MAPT gene expression, wherein the methods include administering to a subject a therapeutically effective amount of an RNAi agent that includes an antisense strand comprising the sequence of any of the sequences in Table 2, Table 3, or Table 9.

In some embodiments, methods for inhibiting expression of a MAPT gene are disclosed herein, wherein the methods include administering to a cell an RNAi agent that includes an antisense strand comprising the sequence of any of the sequences in Table 2, Table 3, or Table 9.

In some embodiments, methods for the treatment (including prophylactic treatment) of a pathological state mediated at least in part by MAPT gene expression are disclosed herein, wherein the methods include administering to a subject a therapeutically effective amount of an RNAi agent that includes a sense strand comprising the sequence of any of the sequences in Table 2, Table 4, Table 5, Table 6, or Table 9.

In some embodiments, methods for inhibiting expression of a MAPT gene are disclosed herein, wherein the methods comprise administering to a cell an RNAi agent that includes a sense strand comprising the sequence of any of the sequences in Table 2, Table 4, Table 5, Table 6, or Table 9.

In some embodiments, methods for the treatment (including prophylactic treatment) of a pathological state mediated at least in part by MAPT gene expression are disclosed herein, wherein the methods include administering to a subject a therapeutically effective amount of an RNAi agent that includes a sense strand comprising the sequence of any of the sequences in Table 4, Table 5, Table 6, or Table 9, and an antisense strand comprising the sequence of any of the sequences in Table 3 or Table 9.

In some embodiments, methods for inhibiting expression of a MAPT gene are disclosed herein, wherein the methods include administering to a cell an RNAi agent that includes a sense strand comprising the sequence of any of the sequences in Table 4, Table 5, Table 6, or Table 9, and an antisense strand comprising the sequence of any of the sequences in Table 3 or Table 9.

In some embodiments, methods of inhibiting expression of a MAPT gene are disclosed herein, wherein the methods include administering to a subject a MAPT RNAi agent that includes a sense strand consisting of the nucleobase sequence of any of the sequences in Table 4, Table 5, Table 6, or Table 9, and the antisense strand consisting of the nucleobase sequence of any of the sequences in Table 3 or Table 9. In other embodiments, disclosed herein are methods of inhibiting expression of a MAPT gene, wherein the methods include administering to a subject a MAPT RNAi agent that includes a sense strand consisting of the modified sequence of any of the modified sequences in Table 4, Table 5, Table 6, or Table 9, and the antisense strand consisting of the modified sequence of any of the modified sequences in Table 3 or Table 9.

In some embodiments, methods for inhibiting expression of a MAPT gene in a cell are disclosed herein, wherein the methods include administering one or more MAPT RNAi agents comprising a duplex structure of one of the duplexes set forth in Tables 7, 8, and 9.

In some embodiments, the gene expression level and/or mRNA level of a MAPT gene in certain CNS cells of subject to whom a described MAPT RNAi agent is administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99%, relative to the subject prior to being administered the MAPT RNAi agent or to a subject not receiving the MAPT RNAi agent. In some embodiments, the MAPT protein levels in certain CNS cells of a subject to whom a described MAPT RNAi agent is administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99%, relative to the subject prior to being administered the MAPT RNAi agent or to a subject not receiving the MAPT RNAi agent. The gene expression level, protein level, and/or mRNA level in the subject may be reduced in a cell, group of cells, and/or tissue of the subject. In some embodiments, the MAPT mRNA levels in certain CNS cells subject to whom a described MAPT RNAi agent has been administered is reduced by at least about 30%, 35%, 40%, 45%, 50%, 55%, 60%, 65%, 70%, 75%, 80%, 85%, 90%, 95%, or 98% relative to the subject prior to being administered the MAPT RNAi agent or to a subject not receiving the MAPT RNAi agent.

A reduction in gene expression, mRNA, and protein levels can be assessed by any methods known in the art. Reduction or decrease in MAPT protein levels are collectively referred to herein as a decrease in, reduction of, or inhibition of MAPT expression. The Examples set forth herein illustrate known methods for assessing inhibition of MAPT gene expression, including but not limited to determining MAPT protein levels.

Cells, Tissues, Organs, and Non-Human Organisms

Cells, tissues, organs, and non-human organisms that include at least one of the MAPT RNAi agents described herein are contemplated. The cell, tissue, organ, or non-human organism is made by delivering the RNAi agent to the cell, tissue, organ, or non-human organism.

ADDITIONAL ILLUSTRATIVE EMBODIMENTS

Provided here are certain additional illustrative embodiments of the disclosed technology. These embodiments are illustrative only and do not limit the scope of the present disclosure or of the claims attached hereto.

Embodiment 1. An RNAi agent for inhibiting expression of a microtubule associated protein tau (MAPT) gene, comprising:
   an antisense strand comprising at least 17 contiguous nucleotides differing by 0 or 1 nucleotides from any one of the sequences provided in Table 2 or Table 3; and
   a sense strand comprising a nucleotide sequence that is at least partially complementary to the antisense strand.

Embodiment 2. The RNAi agent of embodiment 1, wherein the antisense strand comprises nucleotides 2-18 of any one of the sequences provided in Table 2 or Table 3.

Embodiment 3. The RNAi agent of embodiment 1 or embodiment 2, wherein the sense strand comprises a nucleotide sequence of at least 17 contiguous nucleotides differing by 0 or 1 nucleotides from any one of the sequences provided in Table 2 or Table 4, and wherein the sense strand has a region of at least 85% complementarity over the 17 contiguous nucleotides to the antisense strand.

Embodiment 4. The RNAi agent of any one of embodiments 1-3, wherein at least one nucleotide of the RNAi agent is a modified nucleotide or includes a modified internucleoside linkage.

Embodiment 5. The RNAi agent of any one of embodiments 1-4, wherein all or substantially all of the nucleotides are modified nucleotides.

Embodiment 6. The RNAi agent of any one of embodiments 4-5, wherein the modified nucleotide is selected from the group consisting of: 2'-O-methyl nucleotide, 2'-fluoro nucleotide, 2'-deoxy nucleotide, 2',3'-seco nucleotide mimic, locked nucleotide, 2'-F-arabino nucleotide, 2'-methoxyethyl nucleotide, abasic nucleotide, ribitol, inverted nucleotide, inverted 2'-O-methyl nucleotide, inverted 2'-deoxy nucleotide, 2'-amino-modified nucleotide, 2'-alkyl-modified nucleotide, morpholino nucleotide, vinyl phosphonate-containing nucleotide, cyclopropyl phosphonate-containing nucleotide, and 3'-O-methyl nucleotide.

Embodiment 7. The RNAi agent of embodiment 5, wherein all or substantially all of the nucleotides are modified with 2'-O-methyl nucleotides, 2'-fluoro nucleotides, or combinations thereof.

Embodiment 8. The RNAi agent of any one of embodiments 1-7, wherein the antisense strand comprises the nucleotide sequence of any one of the modified sequences provided in Table 3.

Embodiment 9. The RNAi agent of any one of embodiments 1-8, wherein the sense strand comprises the nucleotide sequence of any one of the modified sequences provided in Table 4.

Embodiment 10. The RNAi agent of embodiment 1, wherein the antisense strand comprises the nucleotide sequence of any one of the modified sequences provided in Table 3 and the sense strand comprises the nucleotide sequence of any one of the modified sequences provided in Table 4.

Embodiment 11. The RNAi agent of any one of embodiments 1-10, wherein the sense strand is between 18 and 30 nucleotides in length, and the antisense strand is between 18 and 30 nucleotides in length.

Embodiment 12. The RNAi agent of embodiment 11, wherein the sense strand and the antisense strand are each between 18 and 27 nucleotides in length.

Embodiment 13. The RNAi agent of embodiment 12, wherein the sense strand and the antisense strand are each between 18 and 24 nucleotides in length.

Embodiment 14. The RNAi agent of embodiment 13, wherein the sense strand and the antisense strand are each 21 nucleotides in length.

Embodiment 15. The RNAi agent of embodiment 14, wherein the RNAi agent has two blunt ends.

Embodiment 16. The RNAi agent of any one of embodiments 1-15, wherein the sense strand comprises one or two terminal caps.

Embodiment 17. The RNAi agent of any one of embodiments 1-16, wherein the sense strand comprises one or two inverted abasic residues.

Embodiment 18. The RNAi agent of embodiment 1, wherein the RNAi agent is comprised of a sense strand and an antisense strand that form a duplex having the structure of any one of the duplexes in Table 7A, Table 7B, Table 8, Table 9A, or Table 10.

Embodiment 19. The RNAi agent of embodiment 18, wherein all or substantially all of the nucleotides are modified nucleotides.

Embodiment 20. The RNAi agent of embodiment 1, comprising an antisense strand that consists of, consists essentially of, or comprises a nucleotide sequence that differs by 0 or 1 nucleotides from any one of the following sequences (5'→3'):

```
                                          (SEQ ID NO: 314)
    UAGUCUACCAUGUCGAUGC;

(SEQ ID NO: 132)
    UUGCUUUUACUGACCAUGC;

(SEQ ID NO: 247)
    UGCCUAAUGAGCCACACUU;

(SEQ ID NO: 743)
    UAGUCUACCAUGUCGAUGCUG;

(SEQ ID NO: 746)
    UUGCUUUUACUGACCAUGCGA;
    or (SEQ ID NO: 766)
    UGCCUAAUGAGCCACACUUGG.
```

Embodiment 21. The RNAi agent of embodiment 20, wherein the sense strand consists of, consists essentially of, or comprises a nucleotide sequence that differs by 0 or 1 nucleotides from one of the following nucleotide sequences (5'→3'):

```
                                          (SEQ ID NO: 540)
    GCAUCGACAUGGUAGACUA;

(SEQ ID NO: 358)
    GCAUGGUCAGUAAAAGCAA;
```

-continued

```
                                          (SEQ ID NO: 777)
CAGCAUCGACAUGGUAGACUA;

(SEQ ID NO: 781)
UCGCAUGGUCAGUAAAAGCAA;
or (SEQ ID NO: 779)
CCAAGUGUGGCUCAUUAGGUA.
```

Embodiment 22. The RNAi agent of embodiment 20 or 21, wherein all or substantially all of the nucleotides are modified nucleotides.

Embodiment 23. The RNAi agent of embodiment 1, comprising an antisense strand that comprises, consists of, or consists essentially of a modified nucleotide sequence that differs by 0 or 1 nucleotides from one of the following nucleotide sequences (5'→3'):

```
                                          (SEQ ID NO: 592)
cPrpusAfsgucuAfccauGfuCfgAfugcussg;

(SEQ ID NO: 553)
cPrpusUfsgcuU_{UNA}UfuacuGfaCfcAfugcgssa;
or (SEQ ID NO: 584)
cPrpusGfsccuaAfugagCfcAfcAfcuugsg;
``` wherein a represents 2'-O-methyl adenosine, c represents 2'-O-methyl cytidine, g represents 2'-O-methyl guanosine, u represents 2'-O-methyl uridine; Af represents 2'-fluoro adenosine, Cf represents 2'-fluoro cytidine, Gf represents 2'-fluoro guanosine, Uf represents 2'-fluoro uridine; cPrpu represents 5'-cyclopropyl phosphonate-2'-O-methyl uridine; $U_{UNA}$ represents 2',3'-seco-uridine-3'-phosphate; s represents a phosphorothioate linkage; and wherein all or substantially all of the nucleotides on the sense strand are modified nucleotides.

Embodiment 24. The RNAi agent of embodiment 1, wherein the sense strand comprises, consists of, or consists essentially of a modified nucleotide sequence that differs by 0 or 1 nucleotides from one of the following nucleotide sequences (5'→3'):

```
                                          (SEQ ID NO: 598)
cagcaucgAfcAfUfgguagacua;

(SEQ ID NO: 605)
ucgcauggUfcAfguaaaagcaa;
or (SEQ ID NO: 603)
ccaaguGfuGfgCfucauuaggua;
``` wherein a represents 2'-O-methyl adenosine, c represents 2'-O-methyl cytidine, g represents 2'-O-methyl guanosine, u represents 2'-O-methyl uridine; Af represents 2'-fluoro adenosine, Cf represents 2'-fluoro cytidine, Gf represents 2'-fluoro guanosine, and Uf represents 2'-fluoro uridine.

Embodiment 25. The RNAi agent of any one of embodiments 20-24, wherein the sense strand further includes inverted abasic residues at the 3' terminal end of the nucleotide sequence, at the 5' end of the nucleotide sequence, or at both.

Embodiment 26. The RNAi agent of any one of the preceding embodiments, wherein the RNAi agent is conjugated to a targeting ligand and has the duplex structure of AC005033, AC004265, AC912671, AC004123, AC004125, AC007414, or AC009806.

Embodiment 27. The RNAi agent of any one of embodiments 1-25, wherein the RNAi agent is linked to an antigen binding protein.

Embodiment 28. The RNAi agent of embodiment 27, wherein the antigen binding protein is an antibody fragment (Fab), wherein the Fab specifically binds to one or more epitopes on a transferrin receptor (TfR1).

Embodiment 29. The RNAi agent of embodiment 28, wherein the Fab comprises (i) 6 complementary determining regions (CDRs), (ii) 3 CDRs on the variable light chain (VL), and/or (iii) 3 CDRs on the variable heavy chain (VH).

Embodiment 30. The RNAi agent of embodiment 29, wherein the variable light chain has a VL CDR1 sequence selected from the group consisting of: RASDGLYSNLA (SEQ ID NO: 6), RASDNLYRNLA (SEQ ID NO: 7), and RASDKLYSNLA (SEQ ID NO: 8); a VL CDR2 sequence selected from the group consisting of: DATLLAS (SEQ ID NO: 9), DARNLAS (SEQ ID NO: 10), DAFNLAS (SEQ ID NO: 11), DATRLAS (SEQ ID NO: 12), DATKLAS (SEQ ID NO: 13), and DAKNLAS (SEQ ID NO: 14); and/or a VL CDR 3 sequence of QHFWGTPLT (SEQ ID NO: 15).

Embodiment 31. The RNAi agent of embodiment 29 or 30, wherein the variable light chain is selected from any one of the VL chains shown in Table A.

Embodiment 32. The RNAi agent of any one of embodiments 29-31, wherein the variable heavy chain has a VH CDR1 sequence selected from the group consisting of: GYTFNSYWMH (SEQ ID NO: 16), GYTFKSYWMH (SEQ ID NO: 17), GFTFTSYWMH (SEQ ID NO: 18), GYTFTSYWVH (SEQ ID NO: 19), and GYTFTSYWMH (SEQ ID NO: 20), a VH CDR2 sequence selected from the group consisting of: EINPTNGRVNYIEKFKS (SEQ ID NO: 21), EINPTNGRFNYIEKFKS (SEQ ID NO: 22), EINPTNGRTNYIEKFKS (SEQ ID NO: 23), and EINPTNGRSNYIEKFKS (SEQ ID NO: 24); and/or a VH CDR3 sequence of: GTRAYHY (SEQ ID NO: 25).

Embodiment 33. The RNAi agent of any one of embodiments 29-32, wherein the variable heavy chain is selected from any one of the VH chains shown in Table B.

Embodiment 34. The RNAi agent of any one of embodiments 28-33, wherein the Fab further comprises a light constant chain 1 (CL).

Embodiment 35. The RNAi agent of embodiment 34, wherein the light constant chain 1 (CL) sequence is:

```
                                          (SEQ ID NO: 2)
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC.
```

Embodiment 36. The RNAi agent of any one of embodiments 28-35, wherein the Fab further comprises a heavy constant chain 1 (CH).

Embodiment 37. The RNAi agent of embodiment 36, wherein the heavy constant chain 1 (CH) sequence is:

```
                                          (SEQ ID NO: 4)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTH.
```

Embodiment 38. The RNAi agent of any one of embodiments 28-37, wherein the antibody fragment (Fab) binds TfR1 with an affinity of at least 1 nM KD.

Embodiment 39. The RNAi agent of any one of embodiments 27-38, wherein the antigen binding protein is linked to the sense strand of the RNAi agent.

Embodiment 40. The RNAi agent of embodiment 39, wherein the antigen binding protein is linked to the 5' end of the sense strand.

Embodiment 41. The RNAi agent of embodiment 39, wherein the antigen binding protein is linked to the 3' end of the sense strand.

Embodiment 42. The RNAi agent of any one of embodiments 1-26, wherein the RNAi agent is linked to a lipid moiety.

Embodiment 43. The RNAi agent of embodiment 42, wherein the lipid moiety is conjugated to the sense strand.

Embodiment 44. The RNAi agent of embodiment 43, wherein the lipid moiety is conjugated to the 5' terminal end of the sense strand.

Embodiment 45. A conjugate comprising the RNAi agent of any one of embodiments 1-26 conjugated to an antibody fragment (Fab) that specifically binds to one or more epitopes on a transferrin receptor (TfR1).

Embodiment 46. The conjugate of embodiment 45, wherein the Fab comprises (i) 6 complementary determining regions (CDRs), (ii) 3 CDRs on the variable light chain (VL), or (iii) 3 CDRs on the variable heavy chain (VH).

Embodiment 47. The conjugate of embodiment 46, wherein the variable light chain has a VL CDR1 sequence selected from the group consisting of: RASDGLYSNLA (SEQ ID NO: 6), RASDNLYRNLA (SEQ ID NO: 7), and RASDKLYSNLA (SEQ ID NO: 8); a VL CDR2 sequence selected from the group consisting of: DATLLAS (SEQ ID NO: 9), DARNLAS (SEQ ID NO: 10), DAFNLAS (SEQ ID NO: 11), DATRLAS (SEQ ID NO: 12), DATKLAS (SEQ ID NO: 13), and DAKNLAS (SEQ ID NO: 14); and/or a VL CDR 3 sequence of QHFWGTPLT (SEQ ID NO: 15).

Embodiment 48. The conjugate of embodiment 46 or 47, wherein the variable light chain is selected from any one of the VL chains shown in Table A.

Embodiment 49. The conjugate of any one of embodiments 46-48, wherein the variable heavy chain has a VH CDR1 sequence selected from the group consisting of: GYTFNSYWMH (SEQ ID NO: 16), GYTFKSYWMH (SEQ ID NO: 17), GFTFTSYWMH (SEQ ID NO: 18), GYTFTSYWVH (SEQ ID NO: 19), and GYTFTSYWMH (SEQ ID NO: 20), a VH CDR2 sequence selected from the group consisting of: EINPTNGRVNYIEKFKS (SEQ ID NO: 21), EINPTNGRFNYIEKFKS (SEQ ID NO: 22), EINPTNGRTNYIEKFKS (SEQ ID NO: 23), and EINPTNGRSNYIEKFKS (SEQ ID NO: 24); and/or a VH CDR3 sequence of: GTRAYHY (SEQ ID NO: 25).

Embodiment 50. The conjugate of any one of embodiments 46-49, wherein the variable heavy chain is selected from any one of the VH chains shown in Table B.

Embodiment 51. The conjugate of any one of embodiments 45-50, wherein the Fab further comprises a light constant chain 1 (CL).

Embodiment 52. The conjugate of embodiment 51, wherein the light constant chain 1 (CL) sequence is:

(SEQ ID NO: 2)
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC.

Embodiment 53. The conjugate of any one of embodiments 45-52, wherein the Fab further comprises a heavy constant chain 1 (CH).

Embodiment 54. The conjugate of embodiment 53, wherein the heavy constant chain 1 (CH) sequence is:

(SEQ ID NO: 4)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTH.

Embodiment 55. The conjugate of any one of embodiments 45-54, wherein the antibody fragment (Fab) binds TfR1 with an affinity of at least 1 nM KD.

Embodiment 56. The conjugate of embodiment any one of embodiments 45-55, wherein the RNAi agent is conjugated to the Fab using a covalent or non-covalent bond, ionic bond, hydrogen bond, hydrophobic interaction, peptide, polymer, or a nucleic acid binding protein.

Embodiment 57. The conjugate of any one of embodiments 45-56, wherein the RNAi agent is conjugated to the Fab through a linker comprising a structure selected from the group consisting of:

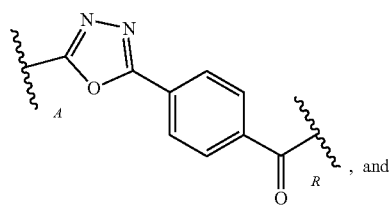, and

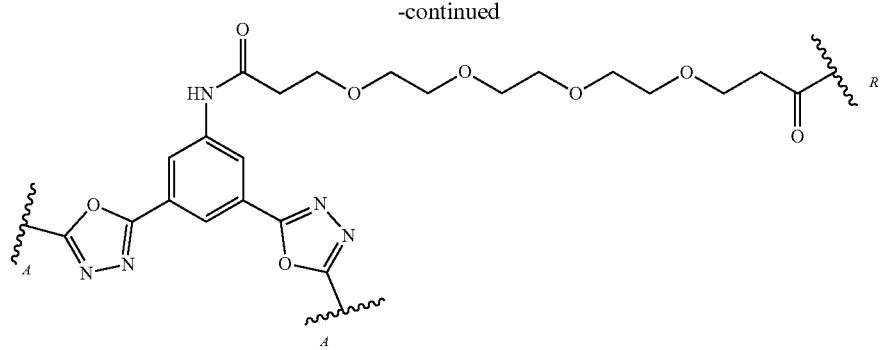

wherein ⸹_A represents a point of attachment to the Fab, and ⸹_R represents a point of attachment to the RNAi agent portion of the conjugate.

Embodiment 58. A composition comprising the RNAi agent of any one of embodiments 1-44, or the conjugate of any one of embodiments 45-57, wherein the composition further comprises a pharmaceutically acceptable excipient.

Embodiment 59. The composition of embodiment 58, further comprising a second RNAi agent capable of inhibiting the expression of MAPT gene expression.

Embodiment 60. The composition of any one of embodiments 58-59, further comprising one or more additional therapeutics.

Embodiment 61. The composition of any one of embodiments 58-60, wherein the RNAi agent is a sodium salt.

Embodiment 62. The composition of any one of embodiments 58-61, wherein the pharmaceutically acceptable excipient is water for injection.

Embodiment 63. The composition of any one of embodiments 58-62, wherein the pharmaceutically acceptable excipient is a buffered saline solution.

Embodiment 64. A method for inhibiting expression of a MAPT gene in a cell, the method comprising introducing into a cell an effective amount of an RNAi agent of any one of embodiments 1-44, the conjugate of any one of embodiments 45-57, or the composition of any one of embodiments 58-63.

Embodiment 65. The method of embodiment 64, wherein the cell is within a subject.

Embodiment 66. The method of embodiment 65, wherein the subject is a human subject.

Embodiment 67. The method of any one of embodiments 64-66, wherein following the administration of the RNAi agent the MAPT gene expression is inhibited by at least about 30%.

Embodiment 68. A method of treating one or more symptoms or diseases that are mediated at least in part by MAPT activity and/or MAPT gene expression, the method comprising administering to a human subject in need thereof a therapeutically effective amount of the RNAi agent of any one of embodiments 1-44, the conjugate of any one of embodiments 45-57, or the composition of any one of embodiments 58-63.

Embodiment 69. The method of embodiment 68, wherein the disease is a neurodegenerative disease.

Embodiment 70. The method of embodiment 69, wherein the neurodegenerative disease is selected from the group consisting of Alzheimer's disease, Frontotemporal lobar degeneration dementia (FTLD), Progressive supranuclear palsy, and other tauopathies.

Embodiment 71. The method of embodiment 70, wherein the disease is Alzheimer's disease.

Embodiment 72. The method of any one of embodiments 64-71, wherein the RNAi agent is administered at a dose of about 0.01 mg/kg to about 5.0 mg/kg of body weight of the subject.

Embodiment 73. The method of any one of embodiments 64-71, wherein the RNAi agent is administered at a dose of about 0.03 mg/kg to about 2.0 mg/kg of body weight of the subject.

Embodiment 74. The method of any one of embodiments 64-73, wherein the RNAi agent is administered in two or more doses.

Embodiment 75. The RNAi agent of any one of embodiments 1-44, or the conjugate of any one of embodiments 45-57, for use in the treatment of a disease, disorder, or symptom that is mediated at least in part by MAPT activity and/or MAPT gene expression.

Embodiment 76. The composition according to any one of embodiments 58-63, for use in the treatment of a disease, disorder, or symptom that is mediated at least in part by MAPT activity and/or MAPT gene expression.

Embodiment 77. The composition according to any one of embodiments 58-63, for use in the manufacture of a medicament for the treatment of a disease, disorder, or symptom that is mediated at least in part by MAPT activity and/or MAPT gene expression.

Embodiment 78. The composition of any one of embodiments 76-77, wherein the disease is a neurodegenerative disease.

Embodiment 79. A method of making an RNAi agent of any one of embodiments 1-44, comprising annealing a sense strand and an antisense strand to form a double-stranded ribonucleic acid molecule.

Embodiment 80. The RNAi agent of any one of embodiments 1-44, the conjugate of any one of embodiments 45-57, or the composition of any one of embodiments 58-63 for use in inhibiting expression of a MAPT gene in a cell.

Embodiment 81. The RNAi agent, conjugate, or composition of embodiment 80, wherein the cell is within a subject.

Embodiment 82. The RNAi agent, conjugate, or composition of embodiment 81, wherein the subject is a human subject.

Embodiment 83. The RNAi agent, conjugate, or composition of any one of embodiments 80-82, wherein following the administration of the RNAi agent the MAPT gene expression is inhibited by at least about 30%.

Embodiment 84. The RNAi agent of any one of embodiments 1-44, the conjugate of any one of embodiments 45-57, or the composition of any one of embodiments 58-63 for use in treating one or more symptoms or diseases that are mediated at least in part by MAPT activity and/or MAPT gene expression.

Embodiment 85. The RNAi agent, conjugate or composition of embodiment 84, wherein the disease is a neurodegenerative disease.

Embodiment 86. The RNAi agent, conjugate or composition of embodiment 85, wherein the neurodegenerative disease is selected from the group consisting of Alzheimer's disease, Frontotemporal lobar degeneration dementia (FTLD), Progressive supranuclear palsy, and other tauopathies.

Embodiment 87. The RNAi agent, conjugate or composition of embodiment 86, wherein the disease is Alzheimer's disease.

Embodiment 88. The RNAi agent, conjugate or composition of any one of embodiments 80-87, wherein the RNAi agent is administered at a dose of about 0.01 mg/kg to about 5.0 mg/kg of body weight of the subject.

Embodiment 89. The RNAi agent, conjugate or composition of any one of embodiments 80-87, wherein the RNAi agent is administered at a dose of about 0.03 mg/kg to about 2.0 mg/kg of body weight of the subject.

Embodiment 90. The RNAi agent, conjugate or composition of any one of embodiments 80-89, wherein the RNAi agent is administered in two or more doses.

Embodiment 91. The RNAi agent of any one of embodiments 42-44, wherein the lipid is selected from the group consisting of:

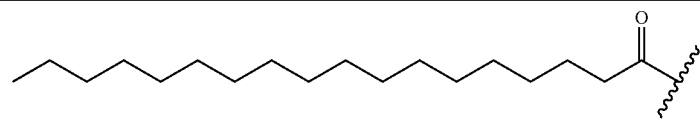

LP128

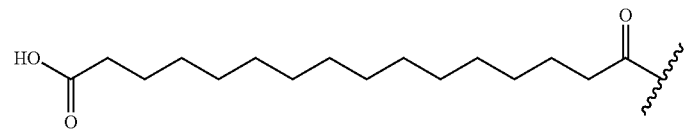 [SMILES: *C(=O)CCCCCCCCCCCCCCC(=O)O]

LP132

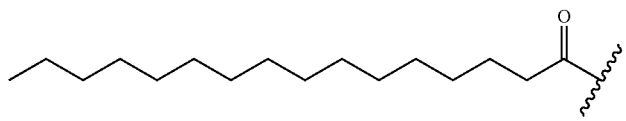 [SMILES: *C(=O)CCCCCCCCCCCCCCC]

LP183

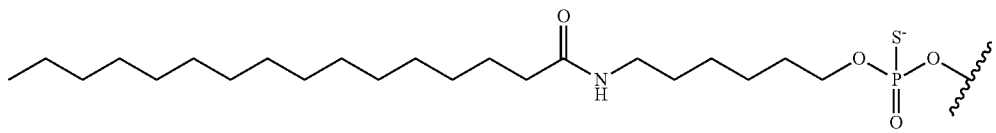

LP183-(NH-C6)s

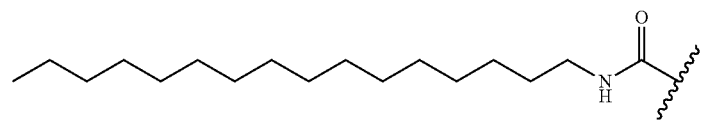 [SMILES: *C(=O)NCCCCCCCCCCCCCCCC]

LP183r

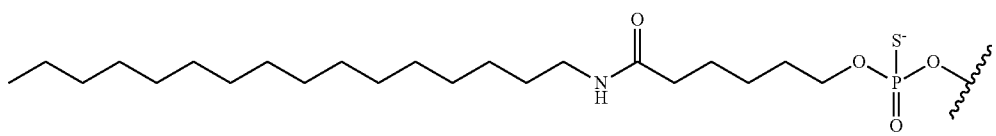

LP183r-(C5)s

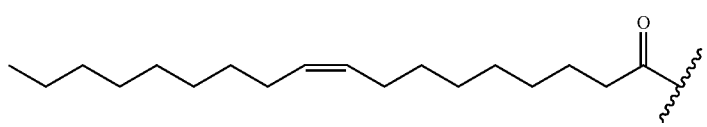 [SMILES: *C(=O)CCCCCCC/C=C\CCCCCCCC]

LP200

-continued
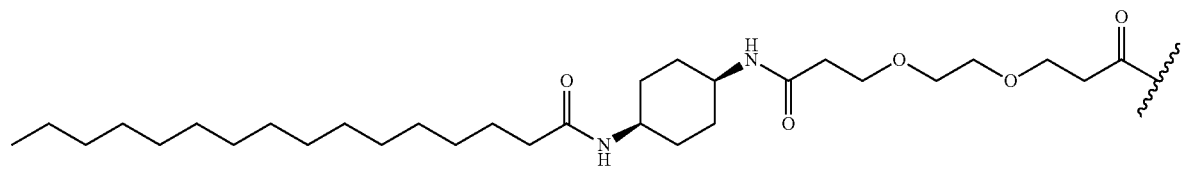 [SMILES: *C(=O)CCOCCOCCC(=O)N[C@H]1CC[C@@H](NC(=O)CCCCCCCCCCCCCCC)CC1]
LP232
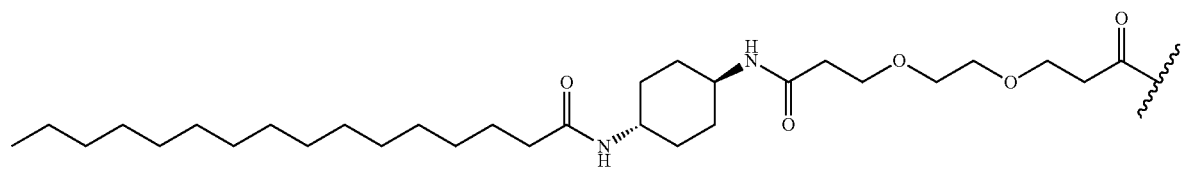 [SMILES: *C(=O)CCOCCOCCC(=O)N[C@H]1CC[C@H](NC(=O)CCCCCCCCCCCCCCC)CC1]
LP-233
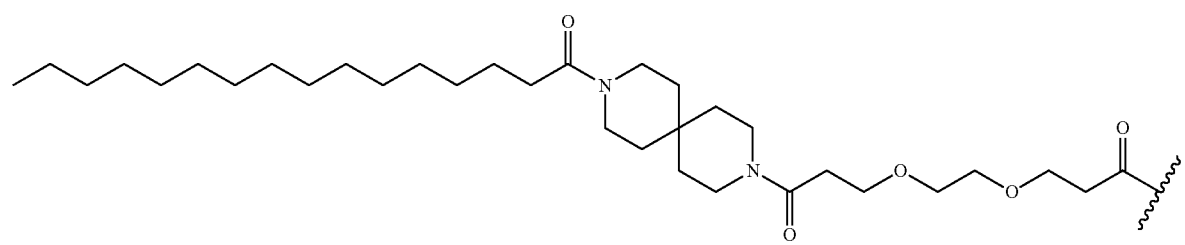 [SMILES: *C(=O)CCOCCOCCC(=O)N1CCC2(CCN(C(=O)CCCCCCCCCCCCCCC)CC2)CC1]
LP242
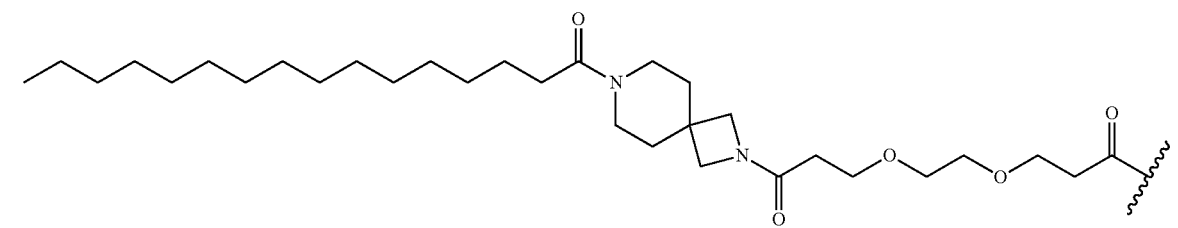 [SMILES: *C(=O)CCOCCOCCC(=O)N1CC2(CCN(C(=O)CCCCCCCCCCCCCCC)CC2)C1]
LP243
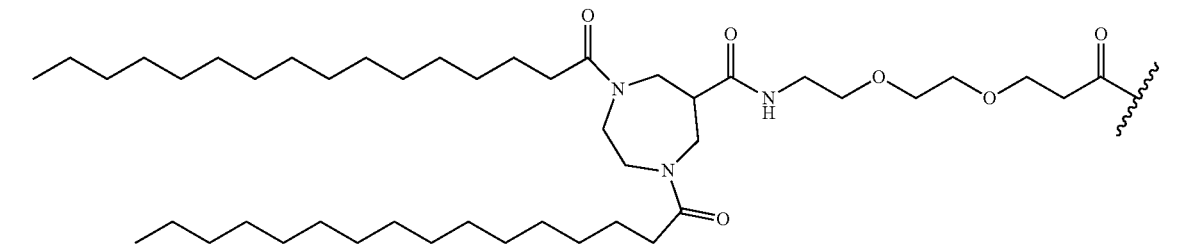 [SMILES: *C(=O)CCOCCOCCNC(=O)C1CN(C(=O)CCCCCCCCCCCCCCC)CCN(C(=O)CCCCCCCCCCCCCCC)C1]
LP245
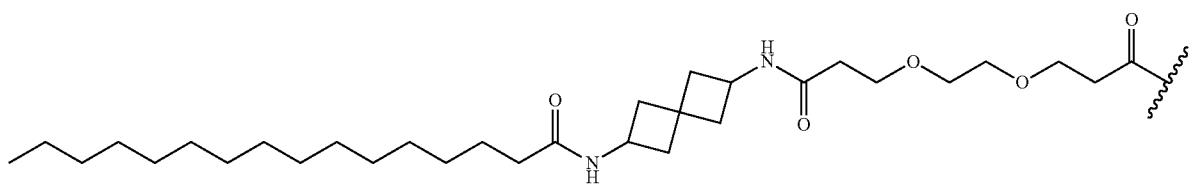 [SMILES: *C(=O)CCOCCOCCC(=O)NC1CC2(CC(NC(=O)CCCCCCCCCCCCCCC)C2)C1]
LP249

-continued
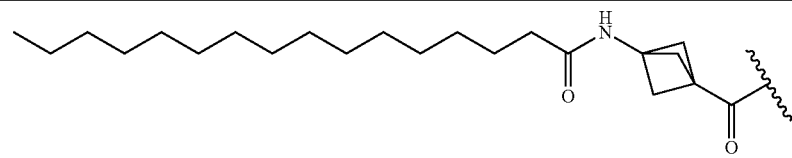
LP257
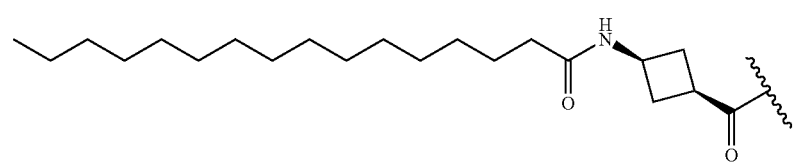 [SMILES: *C(=O)[C@H]1C[C@@H](NC(=O)CCCCCCCCCCCCCCC)C1]
LP259
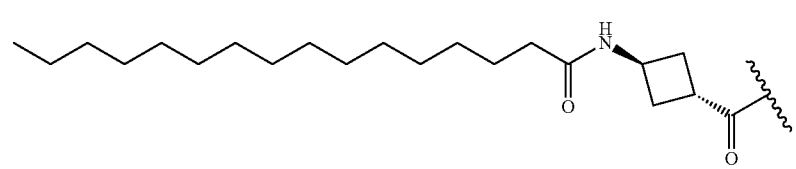 [SMILES: *C(=O)[C@H]1C[C@H](NC(=O)CCCCCCCCCCCCCCC)C1]
LP260
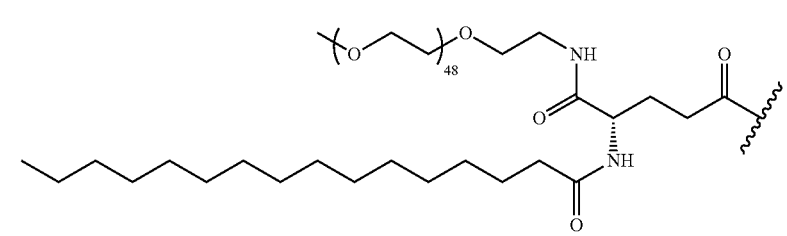
LP262
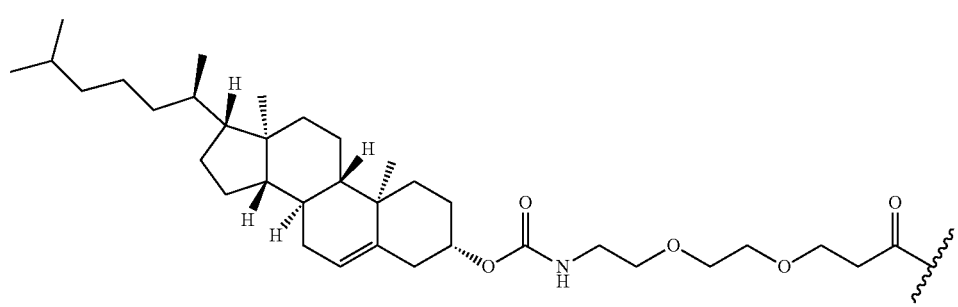 [SMILES: *C(=O)CCOCCOCCNC(=O)O[C@H]1CC[C@@]2(C)C(=CC[C@H]3[C@@H]4CC[C@H]([C@H](C)CCCC(C)C)[C@@]4(C)CC[C@@H]32)C1]
LP269
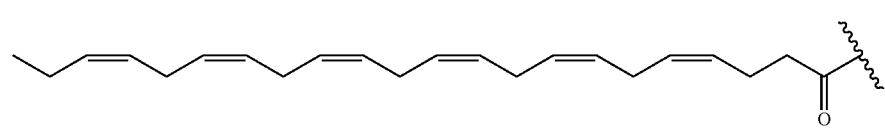 [SMILES: *C(=O)CC/C=C\C/C=C\C/C=C\C/C=C\C/C=C\C/C=C\CC]
LP273
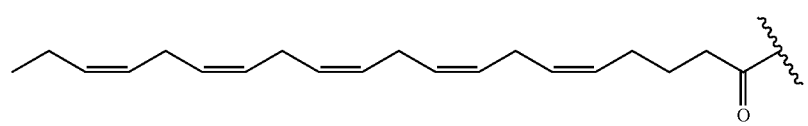 [SMILES: *C(=O)CCC/C=C\C/C=C\C/C=C\C/C=C\C/C=C\CC]
LP274

-continued
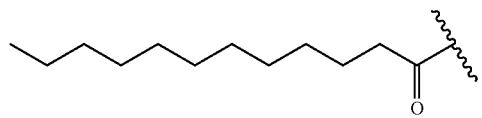 [SMILES: *C(=O)CCCCCCCCCCC]
LP276
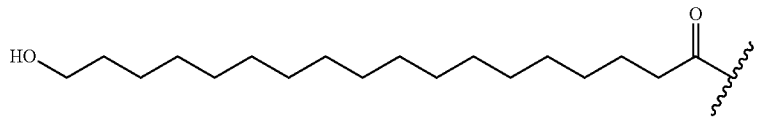 [SMILES: *C(=O)CCCCCCCCCCCCCCCCCO]
LP283
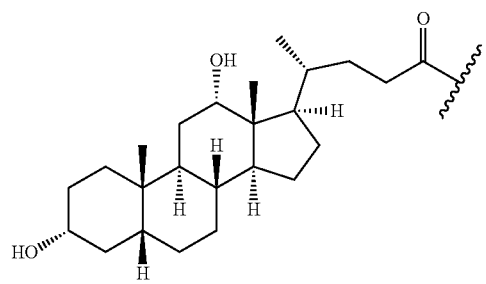
LP286
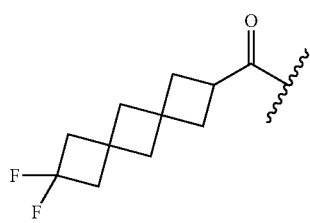 [SMILES: *C(=O)C1CC2(C1)CC1(CC(F)(F)C1)C2]
LP287
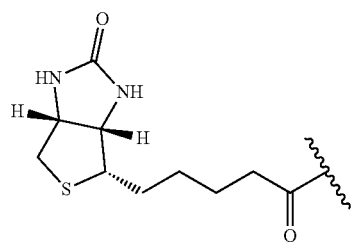 [SMILES: *C(=O)CCCC[C@@H]1SC[C@@H]2NC(=O)N[C@@H]21]
LP289
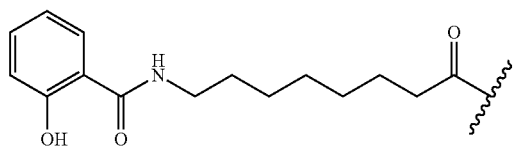 [SMILES: *C(=O)CCCCCCCNC(=O)c1ccccc1O]
LP290
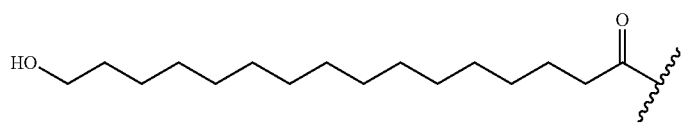 [SMILES: *C(=O)CCCCCCCCCCCCCCCO]
LP293

-continued
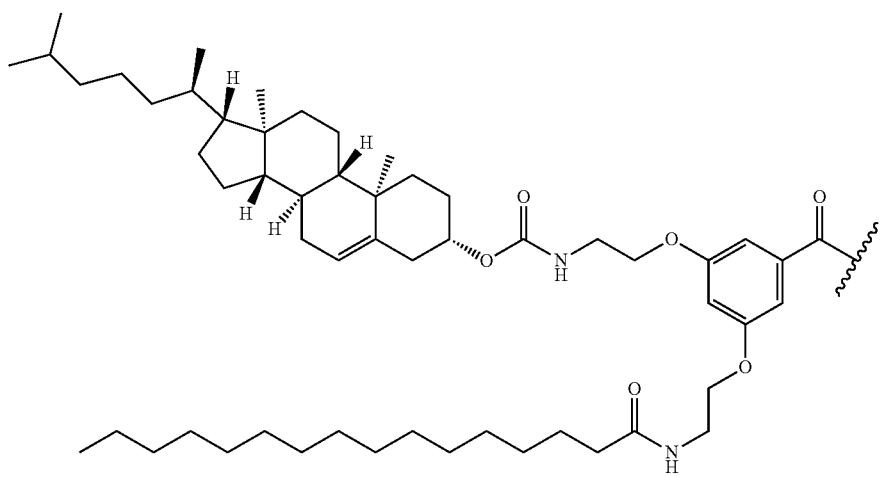 [SMILES: *C(=O)c1cc(OCCNC(=O)CCCCCCCCCCCCCCC)cc(OCCNC(=O)O[C@H]2CC[C@@]3(C)C(=CC[C@H]4[C@@H]5CC[C@H]([C@H](C)CCCC(C)C)[C@@]5(C)CC[C@@H]43)C2)c1]
LP296
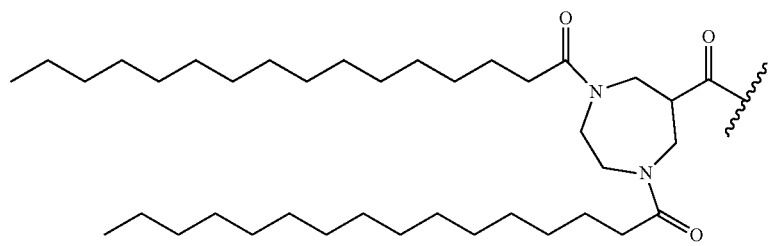 [SMILES: *C(=O)C1CN(C(=O)CCCCCCCCCCCCCCC)CCN(C(=O)CCCCCCCCCCCCCCC)C1]
LP300
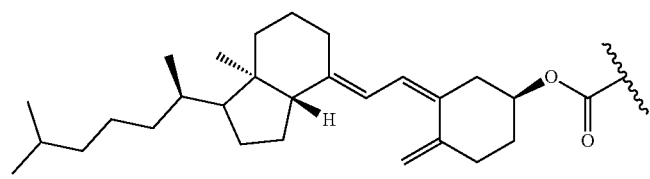 [SMILES: *C(=O)O[C@H]1CCC(=C)/C(=C\C=C2/CCC[C@]3(C)C([C@H](C)CCCC(C)C)CC[C@@H]23)C1]
LP303
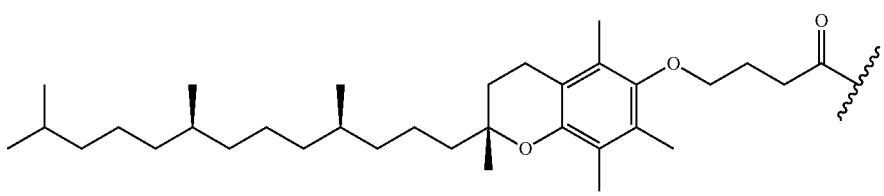 [SMILES: *C(=O)CCCOc1c(C)c(C)c2c(c1C)CC[C@@](C)(CCC[C@H](C)CCC[C@H](C)CCCC(C)C)O2]
LP304
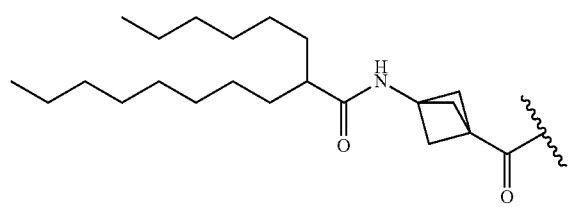 [SMILES: *C(=O)C12CC(NC(=O)C(CCCCCC)CCCCCCCC)(C1)C2]
LP310

-continued
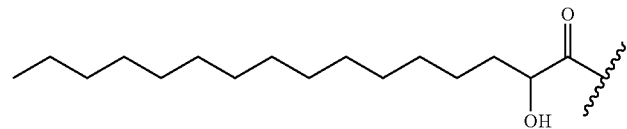 [SMILES: *C(=O)C(O)CCCCCCCCCCCCCC]
LP383
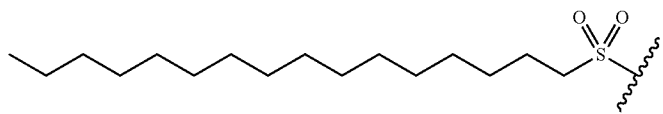 [SMILES: *S(=O)(=O)CCCCCCCCCCCCCCCC]
LP395
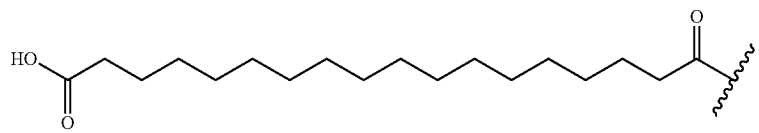 [SMILES: *C(=O)CCCCCCCCCCCCCCCCC(=O)O]
LP396
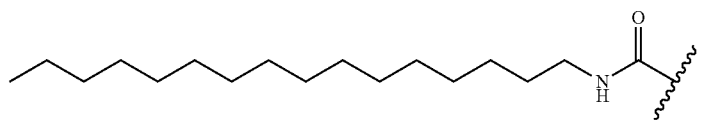 [SMILES: *C(=O)NCCCCCCCCCCCCCCCC]
LP409
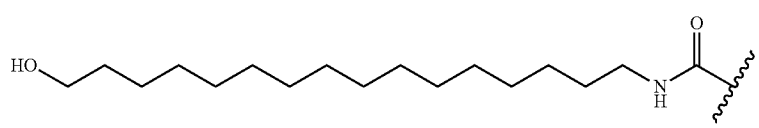 [SMILES: *C(=O)NCCCCCCCCCCCCCCCCO]
LP429
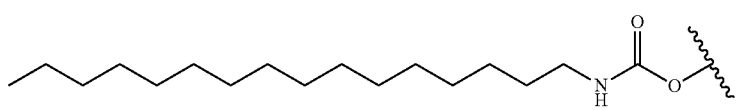 [SMILES: *OC(=O)NCCCCCCCCCCCCCCCC]
LP430
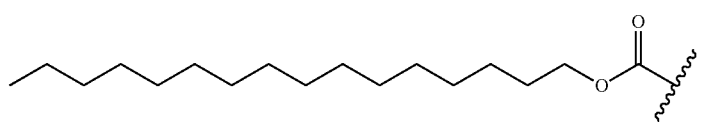 [SMILES: *C(=O)OCCCCCCCCCCCCCCCC]
LP431
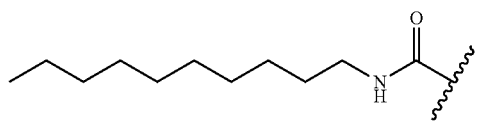 [SMILES: *C(=O)NCCCCCCCCCC]
LP435
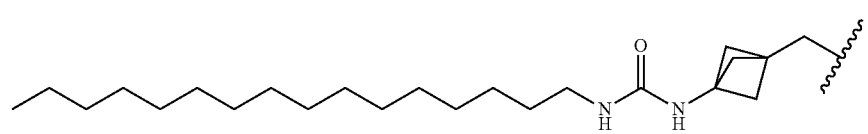 [SMILES: *CC12CC(NC(=O)NCCCCCCCCCCCCCCCC)(C1)C2]
LP439

-continued
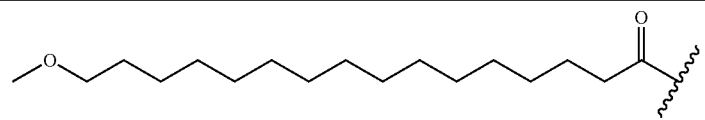
LP440
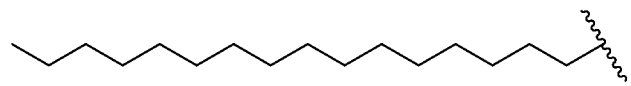 [SMILES: *CCCCCCCCCCCCCCCC]
LP441
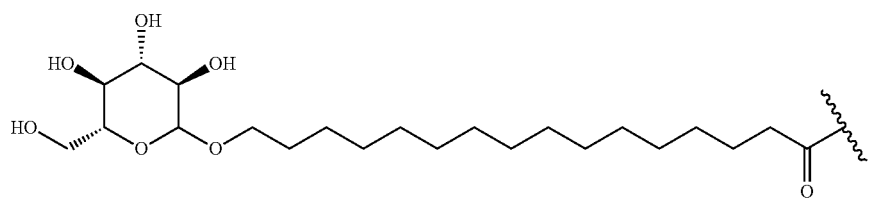 [SMILES: *C(=O)CCCCCCCCCCCCCCCOC1O[C@H](CO)[C@@H](O)[C@H](O)[C@H]1O]
LP456
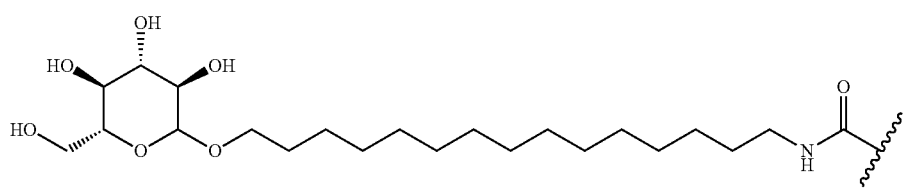 [SMILES: *C(=O)NCCCCCCCCCCCCCCCOC1O[C@H](CO)[C@@H](O)[C@H](O)[C@H]1O]
LP462
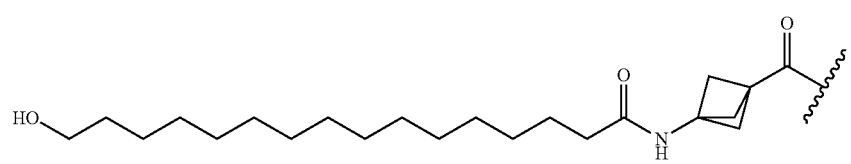 [SMILES: *C(=O)C12CC(NC(=O)CCCCCCCCCCCCCCCO)(C1)C2]
LP463
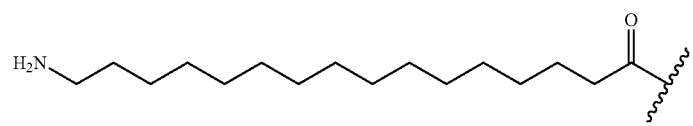 [SMILES: *C(=O)CCCCCCCCCCCCCCCN]
LP464
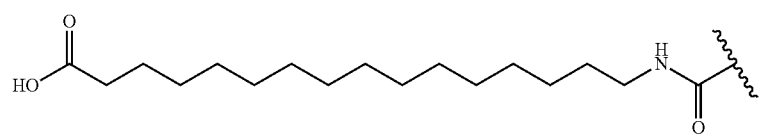 [SMILES: *C(=O)NCCCCCCCCCCCCCCCC(=O)O]
LP465
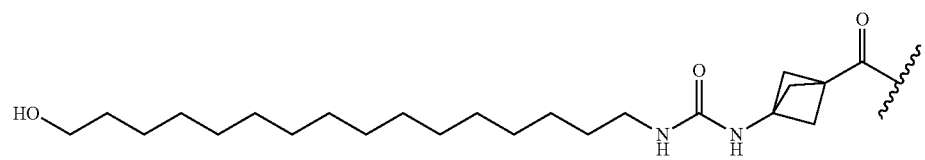
LP466

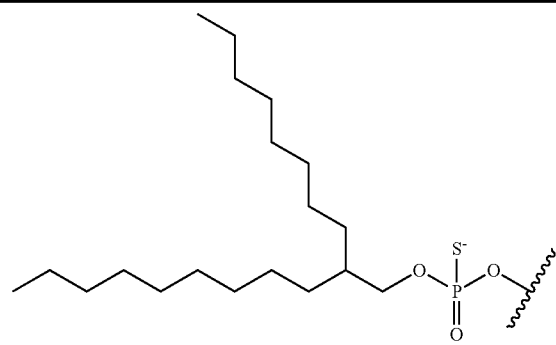
(2C8C12)s
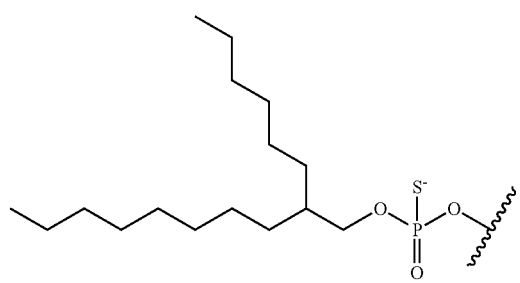
(2C6C10)s
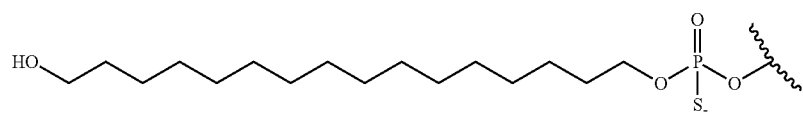
HO-C16s
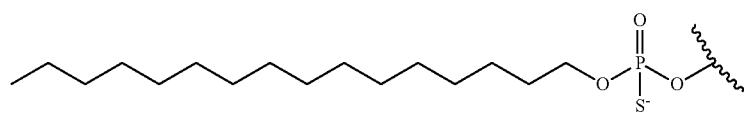
C16, and
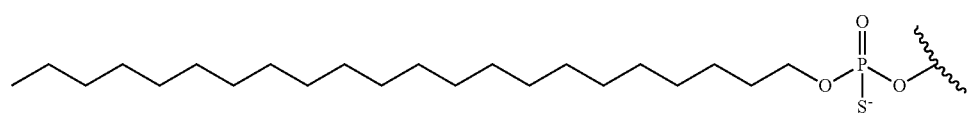
C22s
Embodiment 92. The RNAi agent of any one of embodiments 42-43, wherein the lipid moiety is present on the 2' position of a sense strand nucleotide.
Embodiment 93. The RNAi agent of embodiment 92, wherein the sense strand comprises a nucleotide selected from the group consisting of:

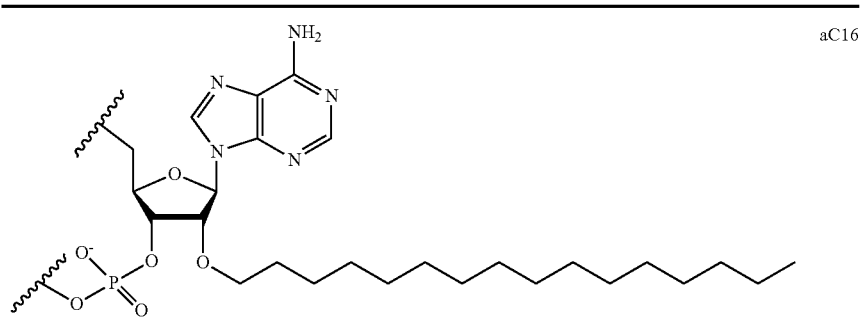
aC16
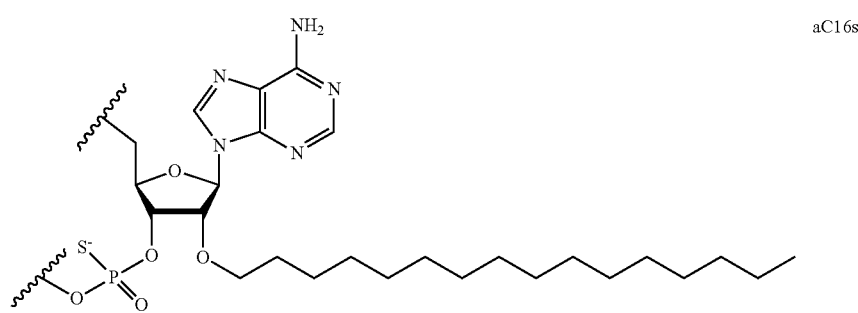
aC16s
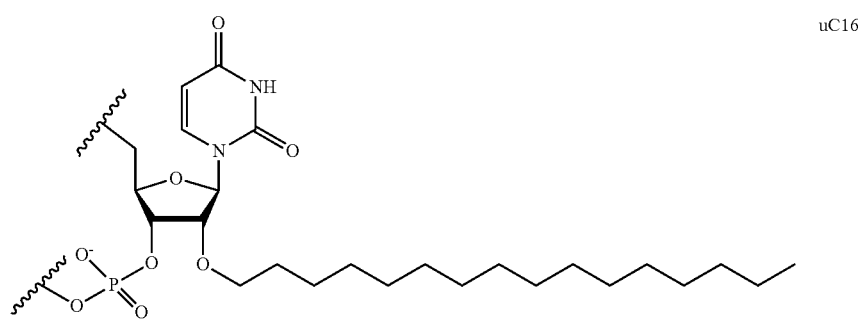
uC16
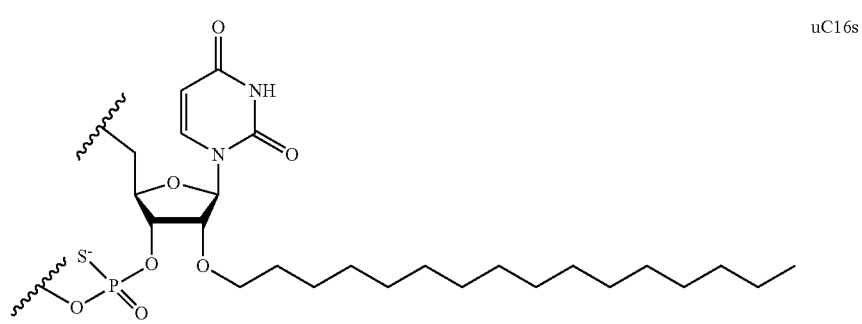
uC16s
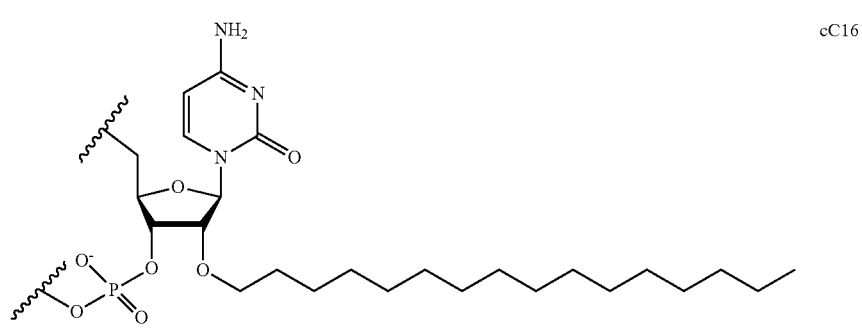
cC16

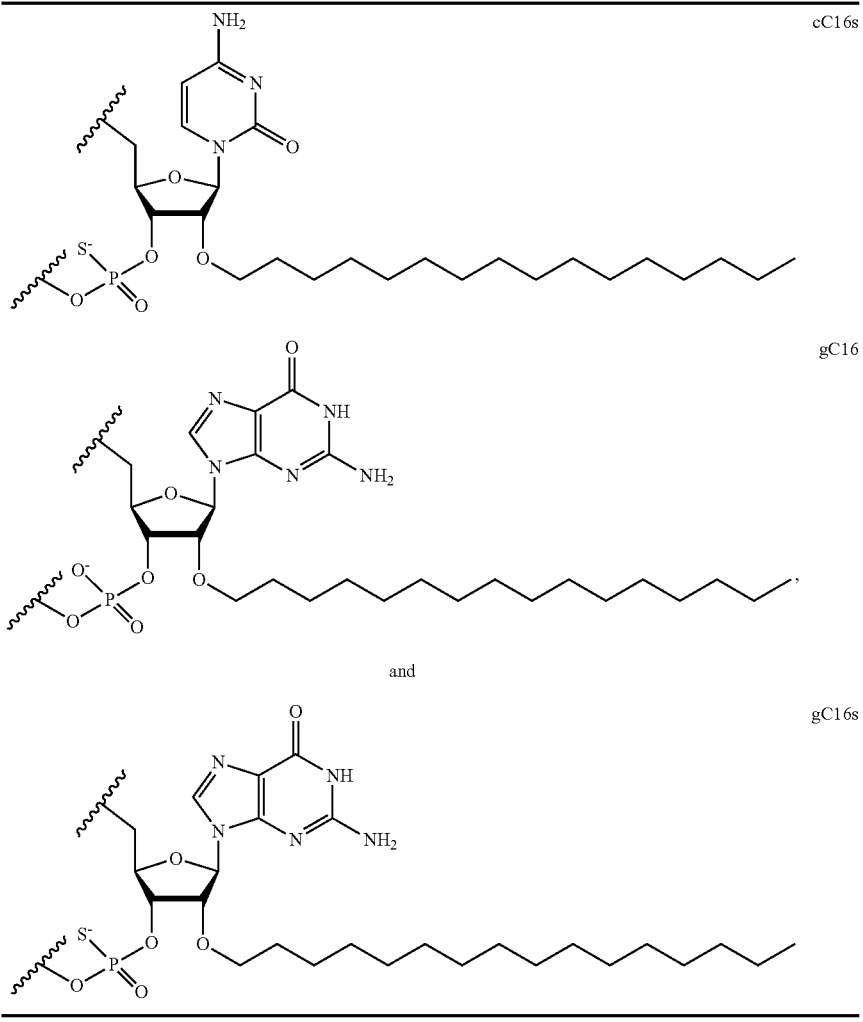

EXAMPLES

Example 1. Synthesis of MAPT RNAi Agents

MAPT RNAi agent duplexes disclosed herein were synthesized in accordance with the following:

A. Synthesis.

The sense and antisense strands of the MAPT RNAi agents were synthesized according to phosphoramidite technology on solid phase used in oligonucleotide synthesis. Depending on the scale, a MerMade96E® (Bioautomation), a MerMade12® (Bioautomation), or an OP Pilot 100 (GE Healthcare) was used. Syntheses were performed on a solid support made of controlled pore glass (CPG, 500 Å or 600 Å, obtained from Prime Synthesis, Aston, PA, USA). All RNA and 2'-modified RNA phosphoramidites were purchased from Thermo Fisher Scientific (Milwaukee, WI, USA). Specifically, the 2'-O-methyl phosphoramidites that were used included the following: (5'-O-dimethoxytrityl-$N^6$-(benzoyl)-2'-O-methyl-adenosine-3'-O-(2-cyanoethyl-N,N-diisopropylamino) phosphoramidite, 5'-O-dimethoxy-trityl-$N^4$-(acetyl)-2'-O-methyl-cytidine-3'-O-(2-cyanoethyl-N,N-diisopropylamino) phosphoramidite, (5'-O-dimethoxytrityl-$N^2$-(isobutyryl)-2'-O-methyl-guanosine-3'-O-(2-cyanoethyl-N,N-diisopropylamino) phosphoramidite, and 5'-O-dimethoxytrityl-2'-O-methyl-uridine-3'-O-(2-cyanoethyl-N,N-diisopropylamino) phosphoramidite. The 2'-deoxy-2'-fluoro-phosphoramidites carried the same protecting groups as the 2'-O-methyl RNA amidites. 5'-dimethoxytrityl-2'-O-methyl-inosine-3'-O-(2-cyanoethyl-N,N-diisopropylamino) phosphoramidites were purchased from Glen Research (Virginia). The inverted abasic (3'-O-dimethoxytrityl-2'-deoxyribose-5'-O-(2-cyanoethyl-N,N-diisopropylamino) phosphoramidites were purchased from ChemGenes (Wilmington, MA, USA). The following UNA phosphoramidites were used: 5'-(4,4'-Dimethoxytrityl)-N6-(benzoyl)-2',3'-seco-adenosine, 2'-benzoyl-3'-[(2-cyanoethyl)-(N,N-diisopropyl)]-phosphoramidite, 5'-(4,4'-Dimethoxytrityl)-N-acetyl-2',3'-seco-cytosine, 2'-benzoyl-3'-[(2-cyanoethyl)-(N,N-diiso-propyl)]-phosphoramidite, 5'-(4,4'-Dimethoxytrityl)-N-isobutyryl-2',3'-seco-guanosine, 2'-benzoyl-3'-[(2-cyanoethyl)-(N,N-diisopropyl)]-phosphoramidite, and 5'-(4,4'-Dimethoxy-trityl)-2',3'-seco-uridine, 2'-benzoyl-3'-[(2-cyanoethyl)-(N,N-diiso-propyl)]-phosphoramidite. TFA aminolink phosphoramidites were also commercially purchased (ThermoFisher). Linker L6 was purchased as propargyl-PEG5-NHS from BroadPharm (catalog #BP-20907) and coupled to the NH2-C6 group from an aminolink phosphoramidite to form -L6-C6-, using standard coupling conditions. The linker Alk-cyHex was similarly commercially purchased from Lumiprobe (alkyne phosphoramidite, 5'-terminal) as a propargyl-containing compound phosphoramidite compound to form the linker -Alk-cyHex-. In each case, phosphorothioate linkages were introduced as specified using the conditions set forth herein. The cyclopropyl phosphonate phosphoramidites were synthesized in accordance with International Patent Application Publication No. WO 2017/214112 (see also Altenhofer et. al., Chem. Communications (Royal Soc. Chem.), 57(55): 6808-6811 (July 2021)).

B. Cleavage and Deprotection of Support Bound Oligomer.

After finalization of the solid phase synthesis, the dried solid support was treated with a 1:1 volume solution of 40 wt. % methylamine in water and 28% to 31% ammonium hydroxide solution (Aldrich) for 1.5 hours at 30° C. The solution was evaporated and the solid residue was reconstituted in water (see below).

C. Purification.

Crude oligomers were purified by anionic exchange HPLC using a TSKgel SuperQ-5PW 13 µm column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC using a GE Healthcare XK 16/40 column packed with Sephadex G-25 fine with a running buffer of 100 mM ammonium bicarbonate, pH 6.7 and 20% Acetonitrile or filtered water. Alternatively, pooled fractions were desalted and exchanged into an appropriate buffer or solvent system via tangential flow filtration.

D. Annealing.

Complementary strands were mixed by combining equimolar RNA solutions (sense and antisense) in 1×PBS (Phosphate-Buffered Saline, 1×, Corning, Cellgro) to form the RNAi agents. Some RNAi agents were lyophilized and stored at −15 to −25° C. Duplex concentration was determined by measuring the solution absorbance on a UV-Vis spectrometer in 1×PBS. The solution absorbance at 260 nm was then multiplied by a conversion factor (0.050 mg/(mL-cm)) and the dilution factor to determine the duplex concentration.

E. Conjugation of RNAi Agents to Fabs.

RNAi agents described herein comprising a free amine were conjugated to L20-p

L20-p

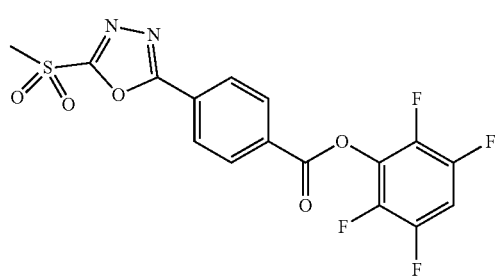

using standard amide reaction chemistry following cleavage from the solid phase. To a solution of Fab in PBS (0.2 umol, 1.0-10.0 mg/mL in PBS) was added a freshly prepared solution of (tris(2-carboxyethyl)phosphine) hydrochloride (TCEP-HCl) in PBS (5-20 eq, 70 mM). The reaction was held overnight at room temperature and covered from light. The next day, TCEP was removed by loading the reaction mixture on a PD-10 desalting column equilibrated with PBS and eluted with PBS. The concentration of Fab in the eluate was determined using the theoretical absorptivity factor at 280 nm. A solution of L20-modified sense strand in sodium phosphate buffer was prepared, and the concentration was determined using the theoretical absorptivity factor at 260 nm. To the desalted Fab solution was added L20-modified sense strand (1-1.3 eq, 0.5-2.5 mM), and the reaction was mixed end-over-end. Analysis by SEC Method 1 and AIEX Method 1 show a mixture of starting Fab, DAR1, and DAR2. After 1 hour, a solution of CP-1113-p (see Table 10 for structure) in DMSO and added to the reaction mixture (3 eq, 36 mM). After 1 hour, a solution of L-cysteine in PBS was added to the reaction mixture (6-10 eq, 165 mM). Finally, the conjugate was annealed by addition of antisense strand (1.2-1.5 eq, 0.5-2.5 mM). The conjugate was purified by an AKTA Pure FPLC system equipped with 20 mM tris pH 8 (Buffer A), 20 mM tris 1500 mM NaCl (Buffer B), and a 5×200 mm column packed with Tosoh SuperQ 5PW (20 micron). The crude reaction mixture was pump loaded onto the column and eluted with a gradient of 10-40% Buffer B. DART and DAR2 fractions were differentiated by SEC Method 1, AEX Method 1, and Nanodrop 260/280 readings. DART fractions were pooled and buffer exchanged to PBS using a PD-10 desalting column. The purified conjugate was analyzed by SEC Method 1 and eluted as a monomeric peak with a retention time of 13.2 minutes.

SEC Method 1

| Mobile phases | Phosphate Buffered Saline pH 7.4 |
|---|---|
| Column | Superdex 200 Increase 10/300 GL Cytiva PN 29219757 |
| Column temperature | 25° C. |
| Autosampler | ambient |
| Injection volume | 40 uL of 1 mg/mL protein (variable) |
| Flow rate | 1.0 mL/min isocratic |
| Wavelength | PDA 190-450 nm; monitor 230 nm, 260 nm, 280 nm |
| Run time | 30 minutes |

AIEX Method 1

| Mobile phases | C: 20 mM tris pH 8.0, D: 20 mM tris 1500 mM NaCl pH 8.0 | | |
|---|---|---|---|
| Column | ProPac SAX-10 4 mm × 250 mm, 10 um Thermo Fisher Scientific PN 054997 | | |
| Column temperature | 30° C. | | |
| Autosampler | 5° C. | | |
| Injection volume | 20 µl of 0.2 mg/mL oligo (variable) | | |
| Flow rate | 1.0 mL/min (variable) | | |
| Wavelength | PDA 190-450 nm; monitor 230 nm, 260 nm, 280 nm | | |
| Run time | 12.5 minutes | | |
| | Time(min) | Event | Value |
| Gradient | 0 | D. Conc | 0 |
| | 0.10 | D. Conc | 0 |
| | 0.11 | D. Conc | 25 |
| | 10.11 | D. Conc | 75 |
| | 10.11 | T. Flow | 1 |
| | 10.12 | D. Conc | 0 |
| | 10.12 | T. Flow | 1.5 |
| | 12.50 | Controller | Stop |

RNAi agents described herein comprising a free amine were conjugated to L1026-p:

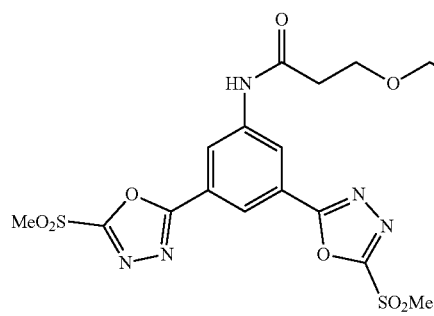

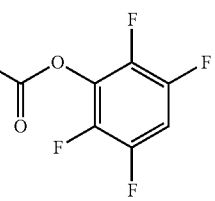

following cleavage from the solid phase according to the following procedure:

To a solution of Fab0070 (28 mg, 0.59 umol, 5.55 mg/mL in PBS) was added a freshly prepared solution of TCEP-HCl in PBS (5 eq, 70 mM, 42 uL). The reduction was mixed end-over-end at ambient temperature for 15 minutes then held at 5° C. overnight without agitation. The next day, TCEP was removed by loading the reaction mixture on two PD-10 desalting columns (Cytiva) equilibrated with 20 mM tris 50 mM NaCl pH 7.6 (alternatively, 20 mM tris pH 8 or PBS buffer can be used) and eluted with the same buffer. The concentration of the Fab in the eluate was determined using the theoretical absorptivity factor at 280 nm. A solution of L-1026-modified sense strand in 10 mM sodium phosphate buffer pH 6.0-6.5 was prepared, and the concentration was determined using the theoretical absorptivity factor at 260 nm. To the desalted Fab solution was added L-1026-modified CS915332 (1.15 eq, 2.75 mM, 240 uL), and the reaction was mixed end-over-end at ambient temperature. Analysis by SEC Method 1 and AIEX Method 1 show a mixture of starting Fab0070, DART product, and DAR2 product. After 30 m, a solution of L-cysteine in 20 mM tris 50 mM NaCl pH 7.6 (alternatively, some L-1026 conjugates have been prepared in 20 mM tris pH 8 or PBS buffer solutions) was added to the reaction mixture (10 eq, 165 mM, 36 uL). After 30 m, the conjugate was annealed by addition of antisense strand (1.3 eq, 1.45 mM in water, 529 uL). The conjugate was purified by an AKTA Pure FPLC system equipped with 20 mM tris pH 8 (Buffer A), 20 mM tris 1500 mM NaCl (Buffer B), and a 5×200 mm column packed with Tosoh SuperQ 5PW (20 micron). The crude reaction mixture was loaded onto the column and eluted with a gradient of 10-40% Buffer B. DART and DAR2 fractions were differentiated by SEC Method 1, AIEX Method 1, and UV-Vis 260/280 measurements. DART fractions were pooled and buffer exchanged to PBS using two PD-10 columns. The purified conjugate was analyzed by SEC Method 1 and eluted as a monomeric peak with a retention time of 7.2 minutes.

SEC Method 1

| | |
|---|---|
| Mobile phases | 2x Phosphate Buffered Saline pH 7.4 |
| Column | ACQUITY UPLC Protein BEH SEC Column, 200 Å, 1.7 μm, 4.6 mm × 300 mm Waters PN 186005226 |
| Column temperature | 30° C. |
| Autosampler | ambient |
| Injection volume | 2-5 uL |
| Flow rate | 0.3 mL/min |
| Wavelength | PDA 190-450 nm |
| Run time | 20 minutes |

AIEX Method 1

| | | | |
|---|---|---|---|
| Mobile phases | C: 20 mM tris pH 8.0, D: 20 mM tris 1500 mM NaCl pH 8.0 | | |
| Column | ProPac SAX-10 4 mm × 250 mm, 10 um Thermo Fisher Scientific PN 054997 | | |
| Column temperature | 30° C. | | |
| Autosampler | 5° C. | | |
| Injection volume | 5-20 μl | | |
| Flow rate | 1.0 mL/min (variable) | | |
| Wavelength | PDA 190-450 nm | | |
| Run time | 12.5 minutes | | |
| | Time(min) | Event | Value |
| Gradient | 0 | D. Conc | 10 |
| | 0.10 | D. Conc | 10 |
| | 0.11 | D. Conc | 25 |
| | 10.11 | D. Conc | 75 |
| | 10.11 | T. Flow | 1 |
| | 10.12 | D. Conc | 10 |
| | 10.12 | T. Flow | 1.5 |
| | 12.50 | Controller | Stop |

F. Synthesis of Lipids

Synthesis of LP293-p

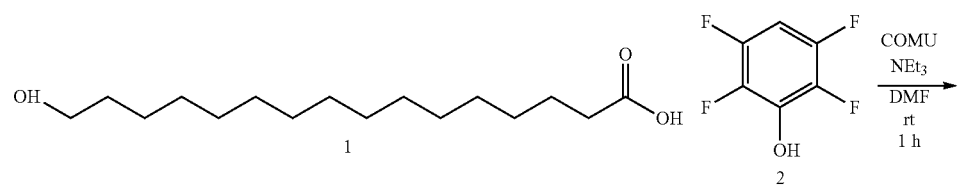

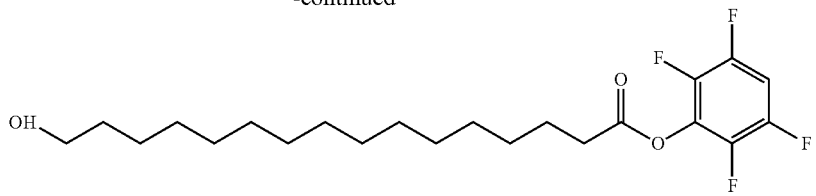

To a solution of compound 1 (73 mg), NEt₃ (0.112 mL), and COMU (126 mg) in DMF was added compound 2 (48.9 mg) under ambient conditions. The reaction was stirred until full conversion was observed by LC-MS. Conversion was not able to be clearly observed by LC-MS, and instead, reaction was allowed to stir for 30 min. until bright yellow color (before the addition of compound 2) transitioned to a honey orange color and all material was observed to be mainly dissolved. The reaction mixture was then washed with water, extracted with DCM, dried over Na₂SO₄, filtered, and concentrated under vacuum. The residue was purified by CombiFlash® via DCM liquid-load onto a 12-g column with a gradient hexanes to 100% EtOAc in which product eluted at 30% B. The product was concentrated under vacuum to provide a white solid residue and confirmed by 1H NMR in CDCl₃.

Synthesis of LP310-p

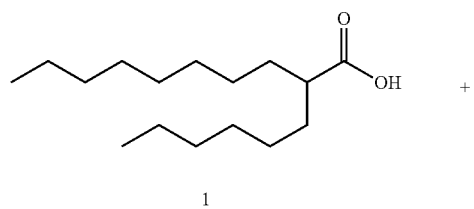

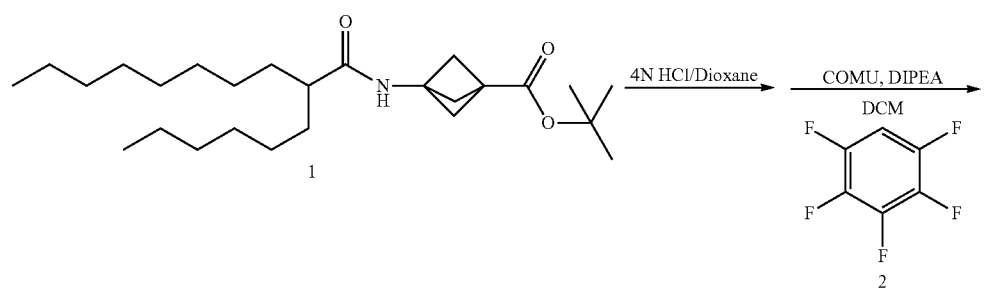

To the solution of 1 in DCM was added DIPEA (0.057 mL), COMU (0.077 g) and 2 (0.0300 g) at room temperature. After stirring at room temperature for 2 h, the reaction was quenched with 0.1N HCl. The organic layer was washed with brine. After removing the solvent, the residue was loaded on a 4 g column. Hexanes to 50% Hexanes in EtOAc as gradient was used to purify. Product was a white solid, 46 mg, 44%. LC-MS: calculated [M+H] 422.36, found 422.61.

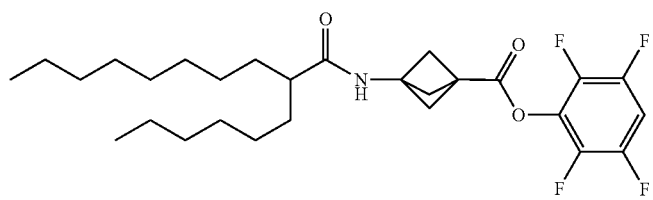

The solution of 1(0.046 g) in 4N HCl/Dioxane (2 mL) was stirred at room temperature overnight. After removing the solvent in vacuo, the residue was placed under high vacuum for 3 h. Then the residue was dissolved in DCM at room temperature, then COMU (0.0700 g), DIPEA (0.038 mL) and 2 (0.036 g) were added at room temperature. After stirring at room temperature for 2 h, the solvent was removed in vacuo. The residue was loaded on a 4 g column. Hexanes to 50% Hexanes in EtOAc as gradient was used to purify. Product was a white solid, 21 mg, 38%. LC-MS: calculated [M+H] 514.29, found 514.61.

Synthesis of LP429-p

Compound 5 (3.47 g, 10.6 mmol) was dissolved in THF (55 mL) and cooled to −15 to −20° C. in a methanol/ice bath. Once cooled, N-methyl morpholine (1.4 mL, 12.7 mmol) and ethyl chloroformate (1.2 mL, 12.7 mmol) were added. The reaction was stirred at −15 for 30 minutes. After 30 minutes a solution of sodium azide (1.72 grams, 26.4 mmol) in water (6.6 mL) was added and the reaction was stirred for 30 minutes at −5°-0° C. in a water/salt/ice bath. The reaction mixture was diluted with EtOAc (20 mL) and water (20 mL). The layers were separated and the aqueous layer was extracted with EtOAc (2×50 mL), the combined organic layers were washed with water (50 mL), brine (50 mL),

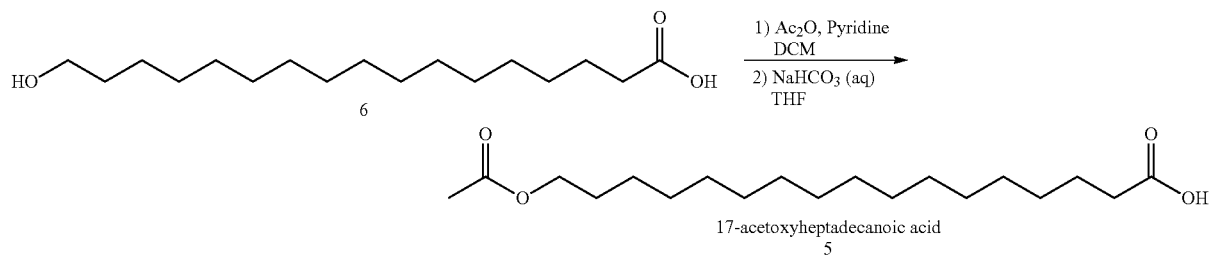

17-hydroxyhexadecanoic acid (6) (3.53 g, 12.3 mmol) was added to a 500 mL RBF. The flask was purged with nitrogen, then DCM (150 mL) was added followed by acetic anhydride (18.6 mL, 197 mmol) and pyridine (30.8 mL, 382 mmol). The reaction was stirred overnight. The reaction mixture was concentrated and azeotroped 3 times with toluene to remove residual pyridine, acetic acid, acetic anhydride. The residue was then stirred in 100 mL of a 1:1 THF/aq. NaHCO₃ mixture for 24 hours. About half of the THF was removed via rotary evaporator and the mixture was diluted with water and acidified with 3 M HCl until a pH of 1. The mixture became very foamy during the acidification. The product was collected by filtration and dried in vacuo to yield 3.22 g (80% yield) of compound 5 as a white solid. The product was not purified further.

dried over sodium sulfate and concentrated to a white solid. Proton NMR showed no remaining starting material based on protons alpha to the carbonyl. The solid was dissolved in toluene (55 mL) and heated to 65° C. until gas evolution stopped (about 30 minutes). The reaction was cooled to room temperature and N-hydroxy succinimide (1.22 g, 10.5 mmol) was added followed by pyridine (0.85 mL, 10.5 mmol). Proton NMR indicated not all the isocyanate was consumed after 2 hours, additional 2 eq of N-hydroxy succinimide (2.43 g, 21.1 mmol) was added. The reaction was stirred overnight. No isocyanate remained by proton NMR after stirring overnight. The reaction mixture was concentrated, the resulting white powder was dissolved in EtOAc (100 mL) and poured into 300 mL hexanes. The precipitate was collected by filtration. Proton NMR of the

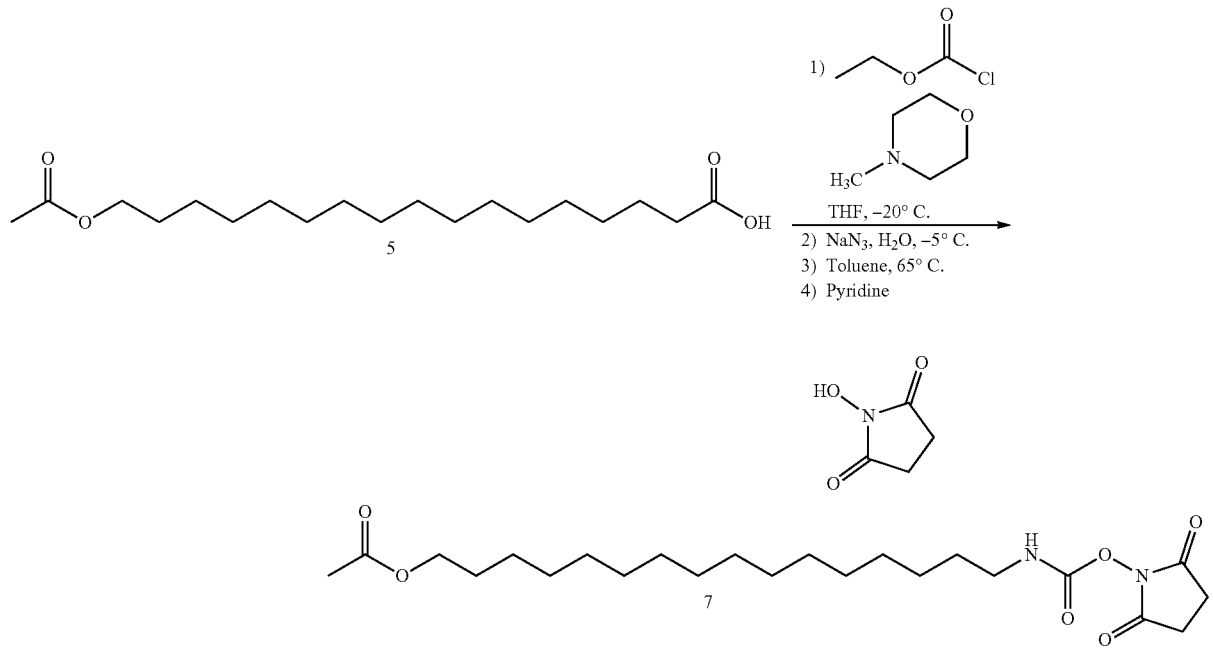

product showed residual N-hydroxy succinimide. The product was dissolved in DCM and purified by silica gel chromatography 65:35 Hexanes:EtOAc to 0:100 Hexanes:EtOAc. Product began eluting at 50% EtOAc and dragged on the column. Fractions containing product were combined to yield 2.25 g (48% yield) of compound 7 as a white solid.

In a 100 mL RBF compound 8 (0.95 g, 2.14 mmol) was dried by 3 successive evaporations of toluene. Diisopropylammonium tetrazolide (0.146 g, 0.86 mmol) and 4 angstrom molecular sieves were added to the flask. The flask was purged and backfilled with nitrogen 3 times, and the solids were dissolved in DCM (50 mL). The mixture was

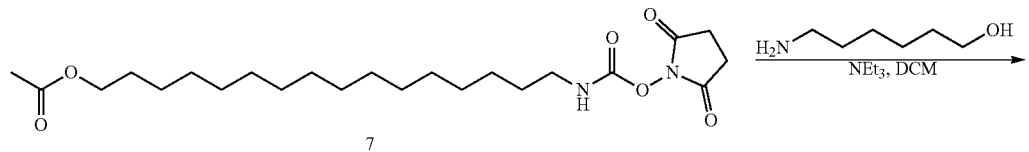

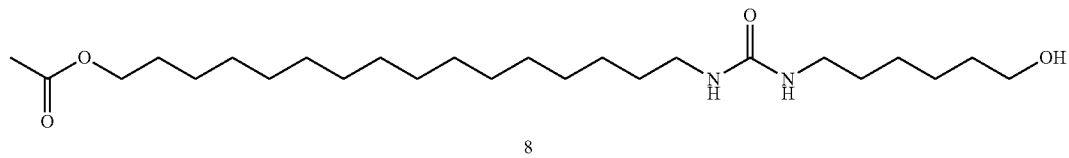

Compound 7 (1.00 g, 2.27 mmol) was added to a solution of 6-amino-1-hexanol (0.266 g, 2.27 mmol) and NEt$_3$ (0.95 mL, 6.81 mmol) in DCM (50 mL). A white ppt formed. No SM remained by LC-MS after 18 hours. The reaction was concentrated by rotary evaporator, the residue was dissolved in about 8 mL of ethyl acetate and was cool to −20° C. in a freezer. A precipitate formed and settled at the bottom of the flask. The EtOAc was decanted off twice and the precipitate was collected and dried under vacuum to yield 0.95 grams (94% yield) of compound 8 as a white powder.

stirred for 30 minutes. After 30 minutes 2-cyanoethyl N,N,N',N'-tetraisopropylphosphorodiamidite (0.98 g, 3.25 mmol) was added and the reaction was stirred for 18 hours. After 18 hours, LC-MS indicated no starting alcohol remained. The reaction was transferred to a separatory funnel, washed with sat. aq. NaHCO$_3$ (2×40 mL), water (40 mL), brine (40 mL), dried over magnesium sulfate and concentrated to dryness. Hexanes was added to the flask and the residue was stirred in hexanes for 2 hours to yield a white precipitate. The white solid was collected by filtration, washed with hexanes (2×20

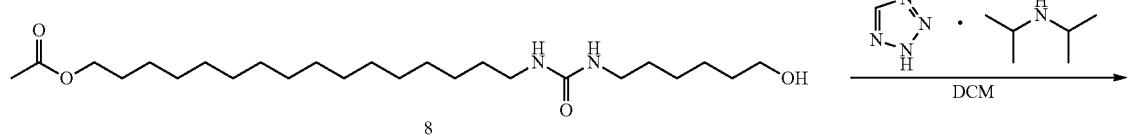

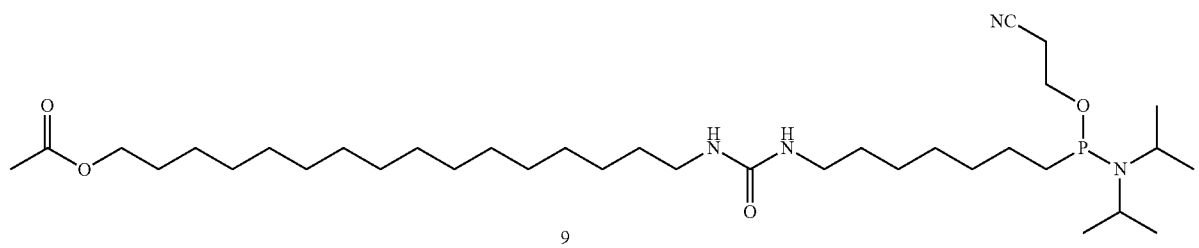

mL), and dried under vacuum to yield 1.2 grams (87% yield) of compound 9 as a white solid.

Synthesis of LP462-p

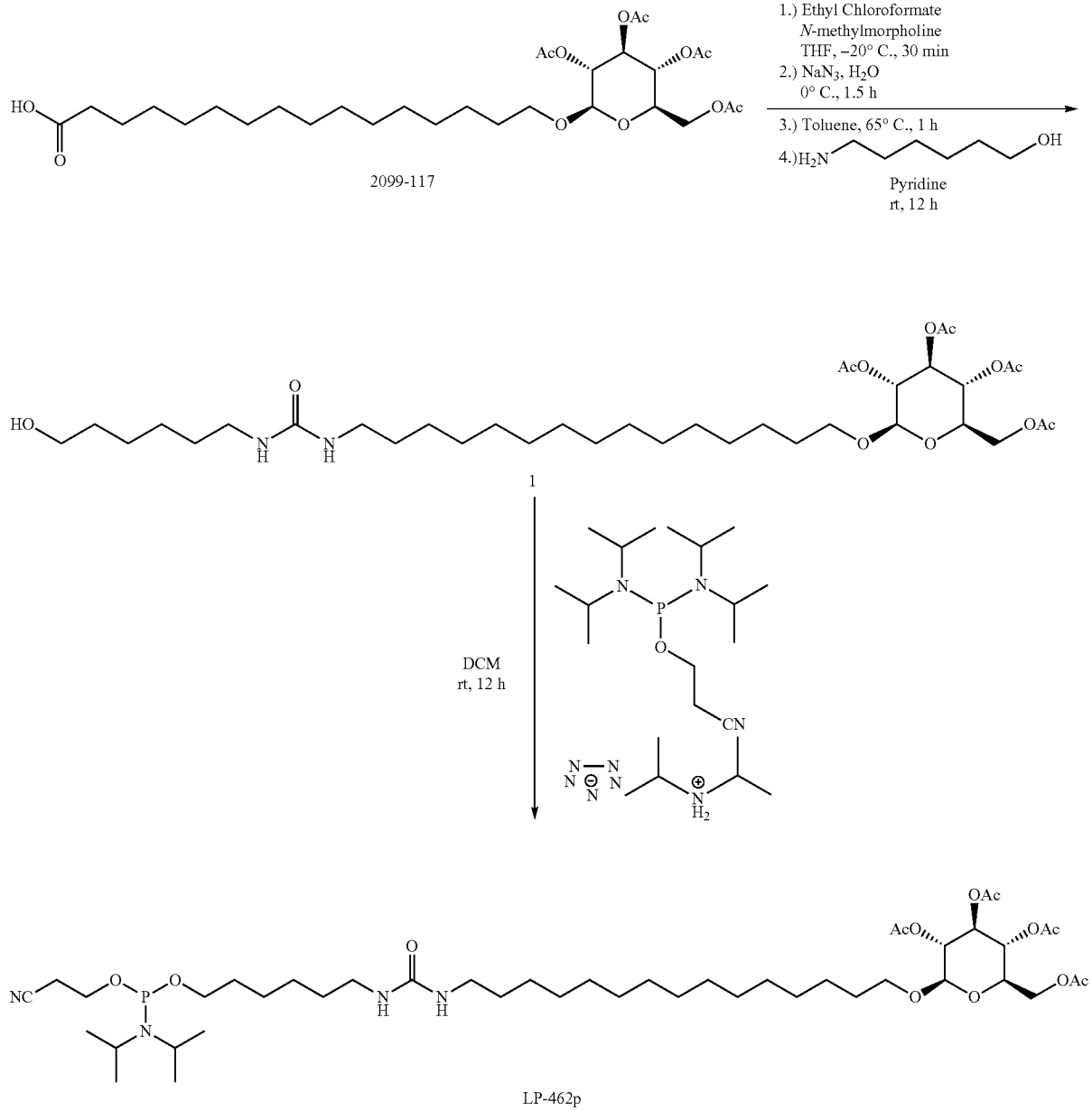

LP-462p

To a round bottom flask containing 2099-117 (1 eq) was added anhydrous THF (30 mL) and the solution was cooled to −20° C. Ethyl chloroformate (1.2) and N-methylmorpholine (1.2 eq) were added to the solution and the solution was stirred at −20° C. to −10° C. for 30 minutes. A solution of sodium azide (2.5 eq) in 1.5 mL of water was added to the reaction and the reaction was stirred at −7° C. for 90 minutes. The reaction was diluted with EtOAc. The aq. layer was separated and extracted 2 additional times with EtOAc. The combined organic layers were washed with brine, dried over $Na_2SO_4$, and concentrated to a clear liquid. The liquid was dissolved in toluene (30 mL) and heated to 65° C. for 1 hour, when no additional nitrogen gas formation was observed. Next, the solution was concentrated under reduced pressure and then dissolved in 30 mL of anhydrous DCM. 6-amino-1-hexanol (3 eq) and pyridine (1 eq) were added to the reaction mixture and stirring was continued for 12 hours. The mixture was concentrated under reduced pressure onto celite and purified via CombiFlash chromatography using 5% methanol in 95% DCM to give compound 1 as an oil in 51% yield. LC-MS [M+H2O]$^+$ 717.4538 m/z, observed 717.4530.

Compound 1 (1 eq) was rotovaped twice with toluene before charging anhydrous DCM (10 mL) to the reaction flask. The suspension was stirred 900 RPM under N2 at ambient temperature with molecular sieves. 2-Cyanoethyl N,N,N',N'-tetraisopropylphosphordiamidite (1.5 eq) was added to the suspension, followed by diisopropylammonium tetrazolide (0.4 eq). After 12 hours, TEA (300 uL) was added, and the reaction mixture was dry loaded onto celite. The product was purified using hexanes: ethyl acetate+1% TEA (60:40) to give LP462-p as an oil in 64% yield. LC-MS [M+H]$^+$ 916.5538 m/z, observed 916.5543.

Conjugation of Lipid PK/PD Modulator Precursors

Either prior to or after annealing, one or more lipid PK/PD modulator precursors can be linked to the RNAi agents disclosed herein. The following describes the general conjugation process used to link lipid PK/PD modulator precursors to the constructs set forth in the Examples depicted herein.

A. Conjugation of Activated Ester PK/PD Modulators

The following procedure was used to conjugate PK/PD modulators having an activated ester moiety such as TFP (tetrafluorophenoxy) or PNP (para-nitrophenol) to an RNAi agent with an amine-functionalized sense strand, such as C6-NH2, NH2-C6, or (NH2-C6). An annealed RNAi Agent dried by lyophilization was dissolved in DMSO and 10% water (v/v %) at 25 mg/mL. Then 50-100 equivalents of TEA and 3 equivalents of activated ester PK/PD modulator were added to the solution. The solution was allowed to react for 1-2 hours, while monitored by RP-HPLC-MS (mobile phase A 100 mM HFIP, 14 mM TEA; mobile phase B: acetonitrile on an Waters™ XBridge C18 column, Waters Corp.)

The product was then precipitated by adding 12 mL acetonitrile and 0.4 mL PBS and centrifuging the solid to a pellet. The pellet was then re-dissolved in 0.4 mL of 1×PBS and 12 mL of acetonitrile. The resulting pellet was dried on high vacuum for one hour.

B. Conjugation of Phosphoramidite PK/PD Modulators

PK/PD modulators having a phosphoramidite moiety may be attached on resin using typical oligonucleotide manufacturing conditions.

C. Hydrolysis of PK/PD Modulators

Certain PK/PD modulators are hydrolyzed in the cleavage and deprotection conditions described in Example 1, above. For example LP-429p and LP-462p include moieties that are hydrolyzed under the cleavage and deprotection conditions.

Example 2. In Vivo Knockdown of MAPT in in Cynomolgus Monkeys

On Study day 0, cynomolgus monkeys were injected with either artificial cerebrospinal fluid (aCSF, obtained from a commercial supplier) or a compound formulation containing either 3 mg/kg at a concentration of 1.5 mg/mL and a volume of 2 mL/kg, 15 mg/kg at a concentration of 7.5 mg/mL and a volume of 2 mL/kg, or 30 mg/kg at a concentration of 7.5 mg/mL and a volume of 4 mL/kg of AC007414 in aCSF according to Table 11 below:

TABLE 11

Dosing groups for the non-human primates of Example 2.

| Group ID | Animals dosed |
|---|---|
| Group 1 (aCSF) | n = 4 |
| Group 2 (3 × 3 mg/kg AC007414) | n = 4 |
| Group 3 (3 × 15 mg/kg AC007414) | n = 4 |
| Group 4 (3 × 30 mg/kg AC007414) | n = 4 |

Four (n=4) monkeys were dosed in each group. Monkeys were injected subcutaneously on days 0, 7, and 14. On study day 29, animals from each group were euthanized and brain and spinal cord tissue was collected from each animal. Samples were analyzed by qPCR for MAPT mRNA knockdown. Samples were analyzed by JESS for protein knockdown. Average mRNA knockdown for frontal cortex, hippocampus and thoracic spinal cord for each group, relative to Group 1, are shown in Table 12 below:

TABLE 12

Relative expression of MAPT mRNA in various tissues analyzed by qPCR for each of the dosing groups of Example 2.

| | | Hippocampus Group Average (n = 4) | | | Frontal Cortex Group Average (n = 4) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.144 | 0.168 | 1.000 | 0.287 | 0.402 |
| 2 | AC007414 (3 mg/kg) | 0.265 | 0.058 | 0.073 | 0.191 | 0.054 | 0.075 |
| 3 | AC007414 (15 mg/kg) | 0.226 | 0.041 | 0.049 | 0.209 | 0.098 | 0.183 |
| 4 | AC007414 (30 mg/kg) | 0.200 | 0.054 | 0.075 | 0.164 | 0.055 | 0.082 |

| | | Thoracic Spinal Cord Group Average (n = 4) | | |
|---|---|---|---|---|
| Group # | Description | Rel. Exp. | Error (Low) | Error (High) |
| 1 | aCSF | 1.000 | 0.192 | 0.238 |
| 2 | AC007414 (3 mg/kg) | 0.372 | 0.068 | 0.083 |
| 3 | AC007414 (15 mg/kg) | 0.252 | 0.023 | 0.025 |
| 4 | AC007414 (30 mg/kg) | 0.257 | 0.012 | 0.012 |

Average protein knockdown for frontal cortex, hippocampus and thoracic spinal cord for each group, relative to Group 1, are shown in FIG. 1.

As can be seen in Table 12 and FIG. 1, MAPT RNAi agent linked to an anti-Transferrin Fab achieved dose dependent and deep knockdown in CNS tissues when injected subcutaneously. The results demonstrate that treatment of MAPT-related diseases and disorder may be mitigated by RNAi agents administered subcutaneously.

Example 3. In Vivo Knockdown of MAPT in in Cynomolgus Monkeys

Cynomolgus monkeys (*Macaca fascicularis*) were injected with either phosphate buffered saline (PBS) or a compound formulation containing 3.0 mg/kg at a concentration of 1.5 mg/mL of AC007414 (formulated in PBS, dose volume 2.0 mL/kg) according to Table 13 below.

TABLE 13

Dosing groups for the non-human primates of Example 3.

| Group ID | Animals Dosed | Dosing Days | Sacrifice Day |
|---|---|---|---|
| Group 1 PBS | n = 4 | SC injection: Day 1, 8, 15 | Day 43 |
| Group 2 3.0 mg/kg AC007414 | n = 4 | SC injection: Day 1, 8, 15 | Day 43 |
| Group 3 3.0 mg/kg AC007414 | n = 4 | SC injection: Day 1, 8, 15 | Day 99 |
| Group 4 3.0 mg/kg AC007414 | n = 4 | SC injection: Day 1 | Day 29 |

Four (n=4) male monkeys were dosed in each group. Animals were dosed, via subcutaneous (SC) injection, on Day 1, Day 8, and Day 15 (Group 4 animals were dosed only on Day 1). In accordance with Table 13 above, on study Day 29, 43, or 99, animals in each test Group were sacrificed. The animals were randomized and assigned to groups using a computer-based procedure.

Prior to dosing, the dose formulations were removed from refrigerated storage and allowed to equilibrate at room temperature for at least 10 minutes. Dose sites were shaved prior to dosing and remarked as necessary throughout the study. Dose one (Day 1) was delivered to the animals' left scapular region, dose two (Day 8) was delivered to the right scapular region and dose three (Day 15) was delivered to the animals' left scapular region. The SC injection site on Day 1 did not overlap with the injection sites of Day 8 or Day 15. Each dose was given using a syringe with 23-25 gauge needle.

Upon sacrifice, animals from each group were euthanized and brain and spinal cord tissue was collected from each animal. Samples were analyzed by qPCR for MAPT mRNA knockdown. Samples were analyzed by JESS for protein knockdown. Average mRNA knockdown for frontal cortex, hippocampus, thoracic spinal cord, temporal cortex, caudate, and putamen for each group, with cPPIB as endogenous gene, normalized to Group 1 animals dosed with PBS, are shown in Tables 14a and 14b below. Groups 2 and 4 were normalized to a first assay of Group 1, shown in Table 14a, and Group 3 was normalized to a separate assay of Group 1, shown in Table 14b.

TABLE 14a

Relative expression of MAPT mRNA in various tissues analyzed by qPCR for dosing groups 1, 2 and 4 of Example 3.

| | | Hippocampus Group Average (n = 4) | | | Frontal Cortex Group Average (n = 4) | | |
|---|---|---|---|---|---|---|---|
| Group # | Sac Day | Rel. Exp. | Error Low | Error High | Rel. Exp. | Error Low | Error High |
| 1. PBS | Day 43 | 1.000 | 0.235 | 0.308 | 1.000 | 0.249 | 0.332 |
| 2. 3x 3.0 mg/kg AC007414 | Day 43 | 0.339 | 0.110 | 0.163 | 0.245 | 0.048 | 0.060 |
| 4. 1x 3.0 mg/kg AC007414 | Day 29 | 0.413 | 0.121 | 0.171 | 0.383 | 0.104 | 0.143 |

| | | Thoracic Spinal Cord Group Average (n = 4) | | | Temporal Cortex Group Average (n = 4) | | |
|---|---|---|---|---|---|---|---|
| Group # | Sac Day | Rel. Exp. | Error Low | Error High | Rel. Exp. | Error Low | Error High |
| 1. PBS | Day 43 | 1.000 | 0.346 | 0.528 | 1.000 | 0.090 | 0.099 |
| 2. 3x 3.0 mg/kg AC007414 | Day 43 | 0.336 | 0.036 | 0.041 | 0.283 | 0.057 | 0.072 |
| 4. 1x 3.0 mg/kg AC007414 | Day 29 | 0.466 | 0.110 | 0.144 | 0.375 | 0.070 | 0.085 |

| | | Caudate Group Average (n = 4) | | | Putamen Group Average (n = 4) | | |
|---|---|---|---|---|---|---|---|
| Group # | Sac Day | Rel. Exp. | Error Low | Error High | Rel. Exp. | Error Low | Error High |
| 1. PBS | Day 43 | 1.000 | 0.193 | 0.239 | 1.000 | 0.076 | 0.082 |
| 2. 3x 3.0 mg/kg AC007414 | Day 43 | 0.278 | 0.026 | 0.029 | 0.297 | 0.042 | 0.049 |
| 4. 1x 3.0 mg/kg AC007414 | Day 29 | 0.434 | 0.060 | 0.070 | 0.413 | 0.063 | 0.074 |

TABLE 14b

Relative expression of MAPT mRNA in various tissues analyzed by qPCR for dosing groups 1 and 3 of Example 3.

| Group # | Sac Day | Hippocampus Group Average (n = 4) | | | Frontal Cortex Group Average (n = 4) | | |
|---|---|---|---|---|---|---|---|
| | | Rel. Exp. | Error Low | Error High | Rel. Exp. | Error Low | Error High |
| 1. PBS | Day 43 | 1.000 | 0.237 | 0.311 | 1.000 | 0.279 | 0.387 |
| 3. 3x 3.0 mg/kg AC007414 | Day 99 | 0.419 | 0.124 | 0.177 | 0.474 | 0.155 | 0.230 |

| Group # | Sac Day | Thoracic Spinal Cord Group Average (n = 4) | | | Temporal Cortex Group Average (n = 4) | | |
|---|---|---|---|---|---|---|---|
| | | Rel. Exp. | Error Low | Error High | Rel. Exp. | Error Low | Error High |
| 1. PBS | Day 43 | 1.000 | 0.335 | 0.503 | 1.000 | 0.106 | 0.119 |
| 3. 3x 3.0 mg/kg AC007414 | Day 99 | 0.485 | 0.060 | 0.069 | 0.359 | 0.107 | 0.153 |

| Group # | Sac Day | Caudate Group Average (n = 4) | | | Putamen Group Average (n = 4) | | |
|---|---|---|---|---|---|---|---|
| | | Rel. Exp. | Error Low | Error High | Rel. Exp. | Error Low | Error High |
| 1. PBS | Day 43 | 1.000 | 0.188 | 0.232 | 1.000 | 0.128 | 0.147 |
| 3. 3x 3.0 mg/kg AC007414 | Day 99 | 0.437 | 0.091 | 0.115 | 0.430 | 0.039 | 0.043 |

Figure 2:
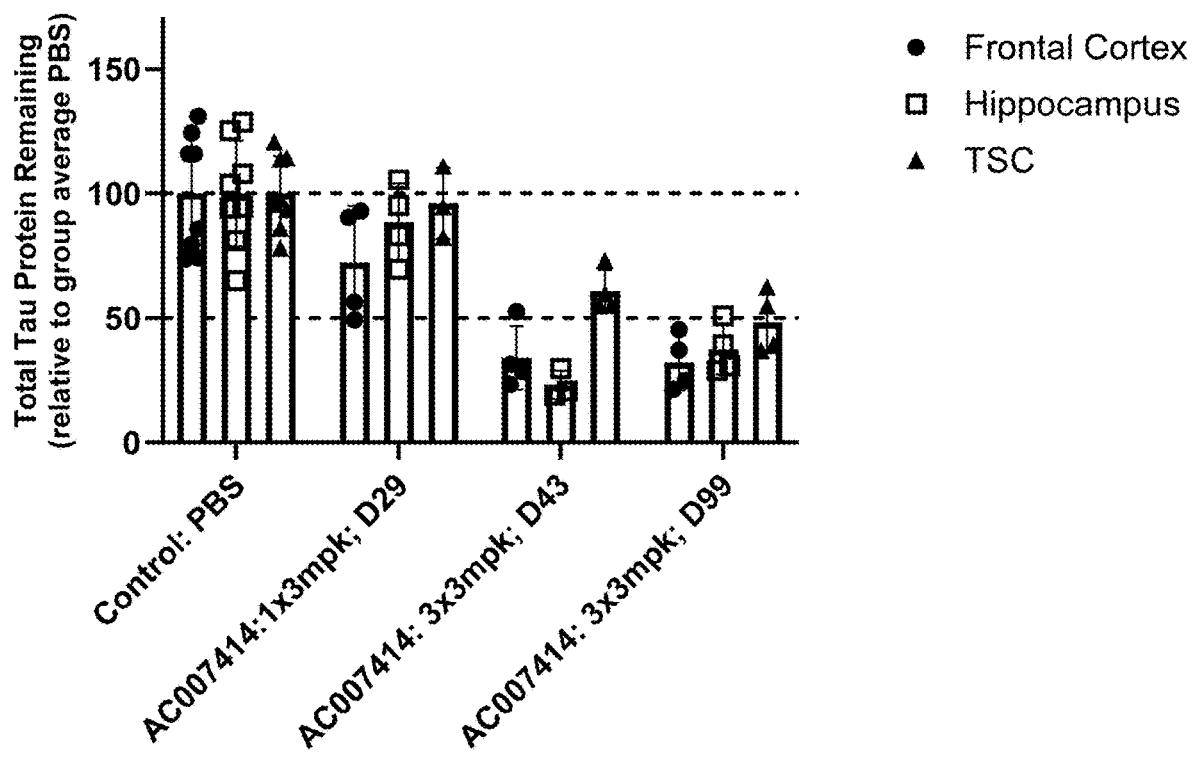
FIG. 2 Depicts the knockdown of MAPT protein in hippocampus, frontal cortex, and thoracic spinal cord in cynomolgus monkeys administered MAPT RNAi agents according to the study described in Example 3.

As can be seen in Tables 14a and 14b, MAPT RNAi agent AC007414 linked to an anti-Transferrin Fab achieved MAPT knockdown in CNS tissues when injected subcutaneously. MAPT mRNA inhibition was observed out to at least Day 99. Most notably, at Day 43, animals dosed with 3× subcutaneous injections of AC007414 at 3.0 mg/kg achieved inhibition of MAPT mRNA in the hippocampus (~66% inhibition, 0.339 relative to control), frontal cortex (~75% inhibition, 0.245 relative to control), thoracic spinal cord (~66% inhibition, 0.336 relative to control), temporal cortex (~72% inhibition, 0.283 relative to control), caudate (~72% inhibition, 0.278 relative to control), and putamen (~70% inhibition, 0.297 relative to control). Average protein knockdown for frontal cortex, hippocampus and thoracic spinal cord for each group, relative to Group 1, are shown in FIG. 2. Similarly, MAPT RNAi agent AC007414 achieved MAPT protein knockdown in CNS tissues out to at least Day 99. Most notably, at Day 43, animals dosed with 3× subcutaneous injections of AC007414 at 3.0 mg/kg achieved inhibition of MAPT protein in the hippocampus (~77%), frontal cortex (~66%), and thoracic spinal cord (~39%).

Example 4. In Vivo Knockdown of MAPT in Transgenic PS19 Mice

On Study day 1, PS19 mice were injected with either 10 µL artificial cerebrospinal fluid (aCSF, obtained from a commercial supplier) or 10 µL of compound formulation at a concentration of 10 mg/mL in aCSF for groups 2-17, according to Table 15 below:

TABLE 15

Dosing groups for the mice of Example 4.

| Group ID | Animals dosed | AC Duplex Number |
|---|---|---|
| Group 1 (aCSF) | n = 4 | N/A |
| Group 2 100 µg AD13081 | n = 4 | AC911178 |

TABLE 15-continued

Dosing groups for the mice of Example 4.

| Group ID | Animals dosed | AC Duplex Number |
|---|---|---|
| Group 3 100 µg AD13082 | n = 4 | AC911179 |
| Group 4 100 µg AD13083 | n = 4 | AC911180 |
| Group 5 100 µg AD13084 | n = 4 | AC911181 |
| Group 6 100 µg AD13085 | n = 4 | AC911182 |
| Group 7 100 µg AD13086 | n = 4 | AC911183 |
| Group 8 100 µg AD13087 | n = 4 | AC911184 |
| Group 9 100 µg AD13088 | n = 4 | AC911185 |
| Group 10 100 µg AD13089 | n = 4 | AC911186 |
| Group 11 100 µg AD13090 | n = 4 | AC911187 |
| Group 12 100 µg AD13091 | n = 4 | AC911188 |
| Group 13 100 µg AD13092 | n = 4 | AC911189 |
| Group 14 100 µg AD13093 | n = 4 | AC911190 |
| Group 15 100 µg AD13094 | n = 4 | AC911191 |
| Group 16 100 µg AD13095 | n = 4 | AC911192 |
| Group 17 100 µg AD13096 | n = 4 | AC911193 |

Four (n=4) mice were dosed in each group. Mice were injected intracerebroventricularly on day 1. On day 8, mice were euthanized and the left half of the brain and thoracic spinal cord were collected and stored in 1000 NBF. Tissue samples were taken from the thoracic spinal cord, cortex, and cerebellum. Samples were analyzed by qPCR for MAPT mRNA knockdown. Average results for each group are shown in Table 16 below:

TABLE 16

Relative expression of MAPT mRNA in various tissues analyzed by qPCR for each of the dosing groups of Example 4.

| Group # | Description | Cortex Group Average (n = 4) | | | Hippocampus Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.122 | 0.139 | 1.000 | 0.228 | 0.296 |
| 2 | 100 µg AC911178 | 0.877 | 0.180 | 0.226 | 0.912 | 0.254 | 0.352 |
| 3 | 100 µg AC911179 | 0.830 | 0.128 | 0.152 | 0.901 | 0.137 | 0.162 |
| 4 | 100 µg AC911180 | 0.998 | 0.240 | 0.315 | 0.667 | 0.045 | 0.048 |
| 5 | 100 µg AC911181 | 0.704 | 0.256 | 0.402 | 0.803 | 0.145 | 0.177 |
| 6 | 100 µg AC911182 | 0.826 | 0.104 | 0.119 | 0.924 | 0.118 | 0.135 |
| 7 | 100 µg AC911183 | 0.698 | 0.156 | 0.202 | 0.781 | 0.139 | 0.169 |
| 8 | 100 µg AC911184 | 0.787 | 0.250 | 0.366 | 0.943 | 0.208 | 0.268 |
| 9 | 100 µg AC911185 | 0.810 | 0.148 | 0.181 | 0.870 | 0.095 | 0.107 |
| 10 | 100 µg AC911186 | 0.967 | 0.112 | 0.126 | 0.994 | 0.044 | 0.046 |
| 11 | 100 µg AC911187 | 0.397 | 0.107 | 0.147 | 0.626 | 0.083 | 0.095 |
| 12 | 100 µg AC911188 | 0.862 | 0.142 | 0.169 | 1.066 | 0.161 | 0.190 |
| 13 | 100 µg AC911189 | 0.913 | 0.151 | 0.181 | 0.942 | 0.148 | 0.175 |
| 14 | 100 µg AC911190 | 0.695 | 0.256 | 0.405 | 1.110 | 0.137 | 0.157 |
| 15 | 100 µg AC911191 | 0.675 | 0.232 | 0.354 | 1.170 | 0.191 | 0.229 |
| 16 | 100 µg AC911192 | 0.854 | 0.227 | 0.310 | 1.058 | 0.160 | 0.189 |
| 17 | 100 µg AC911193 | 0.834 | 0.127 | 0.150 | 0.963 | 0.146 | 0.172 |

| Group # | Description | Thoracic Spinal Cord Group Average (n = 4) | | |
|---|---|---|---|---|
| | | Rel. Exp. | Error (Low) | Error (High) |
| 1 | aCSF | 1.000 | 0.201 | 0.252 |
| 2 | 100 µg AC911178 | 0.742 | 0.145 | 0.180 |
| 3 | 100 µg AC911179 | 0.726 | 0.169 | 0.220 |
| 4 | 100 µg AC911180 | 0.920 | 0.093 | 0.104 |
| 5 | 100 µg AC911181 | 0.555 | 0.074 | 0.086 |
| 6 | 100 µg AC911182 | 0.833 | 0.122 | 0.143 |
| 7 | 100 µg AC911183 | 0.632 | 0.164 | 0.221 |
| 8 | 100 µg AC911184 | 0.875 | 0.204 | 0.266 |
| 9 | 100 µg AC911185 | 0.665 | 0.188 | 0.263 |
| 10 | 100 µg AC911186 | 0.894 | 0.094 | 0.106 |
| 11 | 100 µg AC911187 | 0.829 | 0.210 | 0.281 |
| 12 | 100 µg AC911188 | 0.401 | 0.057 | 0.067 |
| 13 | 100 µg AC911189 | 0.762 | 0.213 | 0.296 |
| 14 | 100 µg AC911190 | 0.884 | 0.068 | 0.074 |
| 15 | 100 µg AC911191 | 0.909 | 0.165 | 0.201 |
| 16 | 100 µg AC911192 | 0.748 | 0.208 | 0.289 |
| 17 | 100 µg AC911193 | 0.604 | 0.063 | 0.071 |

As shown in Table 16, AC911187 demonstrated the greatest knockdown of hMAPT in the cortex and cerebellum, and AC911188 demonstrated the greatest knockdown of hMAPT in the thoracic spinal cord.

Example 5. In Vivo Knockdown of MAPT in Transgenic PS19 Mice

On Study day 1, PS19 mice were injected with either 10 µL artificial cerebrospinal fluid (aCSF, obtained from a commercial supplier) or 10 µL of compound formulation at a concentration of 10 mg/mL in aCSF for groups 2-17, according to Table 17 below:

TABLE 17

Dosing groups for the mice of Example 5.

| Group ID | Animals dosed | AC Duplex Number |
|---|---|---|
| Group 1 (aCSF) | n = 4 | N/A |
| Group 2 100 µg AD13097 | n = 4 | AC911194 |
| Group 3 100 µg AD13098 | n = 4 | AC911195 |
| Group 4 100 µg AD13099 | n = 4 | AC911196 |
| Group 5 100 µg AD13100 | n = 4 | AC911197 |
| Group 6 100 µg AD13101 | n = 4 | AC911198 |
| Group 7 100 µg AD13102 | n = 4 | AC911199 |
| Group 8 100 µg AD13103 | n = 4 | AC911200 |
| Group 9 100 µg AD13104 | n = 4 | AC911201 |
| Group 10 100 µg AD13105 | n = 4 | AC911202 |
| Group 11 100 µg AD13106 | n = 4 | AC911203 |
| Group 12 100 µg AD13107 | n = 4 | AC911204 |
| Group 13 100 µg AD13108 | n = 4 | AC911205 |
| Group 14 100 µg AD13109 | n = 4 | AC911206 |
| Group 15 100 µg AD13110 | n = 4 | AC911207 |
| Group 16 100 µg AD13111 | n = 4 | AC911208 |
| Group 17 100 µg AD13112 | n = 4 | AC911209 |

Four (n=4) mice were dosed in each group. Mice were injected intracerebroventricularly on day 1. On day 8, mice were euthanized and the left half of the brain and thoracic spinal cord were collected and stored in 1000 NBF. Tissue samples were taken from the thoracic spinal cord, cortex, and cerebellum. Samples were analyzed by qPCR for MAPT mRNA knockdown. Average results for each group are shown in Table 18 below:

TABLE 18

Relative expression of MAPT mRNA in various tissues analyzed by qPCR for each of the dosing groups of Example 5.

| Group # | Description | Cortex Group Average (n = 4) | | | Cerebellum Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.184 | 0.226 | 1.000 | 0.088 | 0.096 |
| 2 | 100 μg AC911194 | 1.045 | 0.164 | 0.195 | 1.212 | 0.261 | 0.332 |
| 3 | 100 μg AC911195 | 0.831 | 0.200 | 0.264 | 0.822 | 0.087 | 0.098 |
| 4 | 100 μg AC911196 | 1.059 | 0.204 | 0.253 | 1.052 | 0.122 | 0.138 |
| 5 | 100 μg AC911197 | 1.293 | 0.227 | 0.275 | 0.857 | 0.174 | 0.219 |
| 6 | 100 μg AC911198 | 1.074 | 0.104 | 0.115 | 0.699 | 0.065 | 0.072 |
| 7 | 100 μg AC911199 | 0.695 | 0.139 | 0.174 | 0.412 | 0.135 | 0.202 |
| 8 | 100 μg AC911200 | 1.075 | 0.139 | 0.160 | 0.675 | 0.171 | 0.229 |
| 9 | 100 μg AC911201 | 0.688 | 0.093 | 0.107 | 0.491 | 0.041 | 0.045 |
| 10 | 100 μg AC911202 | 1.027 | 0.176 | 0.213 | 0.774 | 0.081 | 0.091 |
| 11 | 100 μg AC911203 | 0.870 | 0.087 | 0.096 | 0.913 | 0.206 | 0.266 |
| 12 | 100 μg AC911204 | 0.766 | 0.187 | 0.247 | 0.837 | 0.108 | 0.124 |
| 13 | 100 μg AC911205 | 1.025 | 0.121 | 0.138 | 0.837 | 0.069 | 0.075 |
| 14 | 100 μg AC911206 | 0.936 | 0.149 | 0.178 | 0.732 | 0.192 | 0.260 |
| 15 | 100 μg AC911207 | 0.945 | 0.118 | 0.134 | 1.007 | 0.239 | 0.313 |
| 16 | 100 μg AC911208 | 0.961 | 0.172 | 0.209 | 0.963 | 0.194 | 0.242 |
| 17 | 100 μg AC911209 | 0.477 | 0.070 | 0.083 | 0.640 | 0.211 | 0.315 |

| Group # | Description | Thoracic Spinal Cord Group Average (n = 4) | | |
|---|---|---|---|---|
| | | Rel. Exp. | Error (Low) | Error (High) |
| 1 | aCSF | 1.000 | 0.094 | 0.103 |
| 2 | 100 μg AC911194 | 1.196 | 0.265 | 0.341 |
| 3 | 100 μg AC911195 | 0.615 | 0.074 | 0.084 |
| 4 | 100 μg AC911196 | 1.025 | 0.230 | 0.297 |
| 5 | 100 μg AC911197 | 1.152 | 0.187 | 0.223 |
| 6 | 100 μg AC911198 | 0.799 | 0.178 | 0.229 |
| 7 | 100 μg AC911199 | 0.455 | 0.150 | 0.223 |
| 8 | 100 μg AC911200 | 0.878 | 0.236 | 0.323 |
| 9 | 100 μg AC911201 | 0.553 | 0.101 | 0.124 |
| 10 | 100 μg AC911202 | 1.113 | 0.250 | 0.322 |
| 11 | 100 μg AC911203 | 0.802 | 0.135 | 0.162 |
| 12 | 100 μg AC911204 | 0.633 | 0.109 | 0.132 |
| 13 | 100 μg AC911205 | 0.943 | 0.145 | 0.172 |
| 14 | 100 μg AC911206 | 0.815 | 0.178 | 0.227 |
| 15 | 100 μg AC911207 | 0.969 | 0.155 | 0.184 |
| 16 | 100 μg AC911208 | 0.963 | 0.303 | 0.443 |
| 17 | 100 μg AC911209 | 0.384 | 0.070 | 0.086 |

As shown in Table 18, AC911209 demonstrated the greatest knockdown of hMAPT in the cortex and thoracic spinal cord, and AC911199 demonstrated the greatest knockdown of hMAPT in the cerebellum.

Example 6. In Vivo Knockdown of MAPT in Transgenic PS19 Mice

On Study day 1, PS19 mice were injected with either 10 μL artificial cerebrospinal fluid (aCSF, obtained from a commercial supplier) or 10 μL of compound formulation at a concentration of 7 mg/mL in aCSF for groups 2-13, according to Table 19 below:

TABLE 19

Dosing groups for the mice of Example 6.

| Group ID | Animals dosed | AC Duplex Number |
|---|---|---|
| Group 1 (aCSF) | n = 4 | N/A |
| Group 2 70 μg AD13112 | n = 4 | AC911209 |

TABLE 19-continued

Dosing groups for the mice of Example 6.

| Group ID | Animals dosed | AC Duplex Number |
|---|---|---|
| Group 3 70 μg AD13904 | n = 4 | AC912001 |
| Group 4 70 μg AD13905 | n = 4 | AC912002 |
| Group 5 70 μg AD13906 | n = 4 | AC912003 |
| Group 6 70 μg AD13907 | n = 4 | AC912004 |
| Group 7 70 μg AD13908 | n = 4 | AC912005 |
| Group 8 70 μg AD13909 | n = 4 | AC912006 |
| Group 9 70 μg AD13910 | n = 4 | AC912007 |
| Group 10 70 μg AD13911 | n = 4 | AC912008 |

TABLE 19-continued

Dosing groups for the mice of Example 6.

| Group ID | Animals dosed | AC Duplex Number |
|---|---|---|
| Group 11 70 µg AD13912 | n = 4 | AC912009 |
| Group 12 70 µg AD13913 | n = 4 | AC912010 |
| Group 13 70 µg AD13914 | n = 4 | AC912011 |

Four (n=4) mice were dosed in each group. Mice were injected intracerebroventricularly on day 1. On day 8, mice were euthanized and the left half of the brain and thoracic spinal cord were collected and stored in 1000 NBF. Tissue samples were taken from the thoracic spinal cord, cortex, and hippocampus. Samples were analyzed by qPCR for MAPT mRNA knockdown. Average results for each group are shown in Table 20 below:

TABLE 20

Relative expression of MAPT mRNA in various tissues analyzed by qPCR for each of the dosing groups of Example 6.

| Group # | Description | Cortex Group Average (n = 4) | | | Hippocampus Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.308 | 0.446 | 1.000 | 0.229 | 0.296 |
| 2 | 70 µg AC911209 | 0.836 | 0.152 | 0.186 | 0.686 | 0.212 | 0.307 |
| 3 | 70 µg AC912001 | 0.748 | 0.105 | 0.122 | 0.687 | 0.077 | 0.087 |
| 4 | 70 µg AC912002 | 0.839 | 0.212 | 0.283 | 0.640 | 0.152 | 0.200 |
| 5 | 70 µg AC912003 | 0.669 | 0.152 | 0.196 | 0.400 | 0.099 | 0.132 |
| 6 | 70 µg AC912004 | 0.811 | 0.221 | 0.303 | 0.554 | 0.158 | 0.221 |
| 7 | 70 µg AC912005 | 0.554 | 0.161 | 0.228 | 0.420 | 0.152 | 0.239 |
| 8 | 70 µg AC912006 | 0.503 | 0.228 | 0.419 | 0.450 | 0.250 | 0.561 |
| 9 | 70 µg AC912007 | 0.505 | 0.201 | 0.335 | 0.400 | 0.112 | 0.156 |
| 10 | 70 µg AC912008 | 0.617 | 0.164 | 0.223 | 0.401 | 0.160 | 0.267 |
| 11 | 70 µg AC912009 | 0.731 | 0.140 | 0.173 | 0.580 | 0.106 | 0.130 |
| 12 | 70 µg AC912010 | 0.785 | 0.209 | 0.285 | 0.723 | 0.200 | 0.276 |
| 13 | 70 µg AC912011 | 0.640 | 0.183 | 0.256 | 0.460 | 0.129 | 0.180 |

| Group # | Description | Thoracic Spinal Cord Group Average (n = 4) | | |
|---|---|---|---|---|
| | | Rel. Exp. | Error (Low) | Error (High) |
| 1 | aCSF | 1.000 | 0.393 | 0.647 |
| 2 | 70 µg AC911209 | 0.961 | 0.146 | 0.172 |
| 3 | 70 µg AC912001 | 0.851 | 0.096 | 0.108 |
| 4 | 70 µg AC912002 | 0.754 | 0.145 | 0.179 |
| 5 | 70 µg AC912003 | 0.911 | 0.214 | 0.279 |
| 6 | 70 µg AC912004 | 0.934 | 0.105 | 0.118 |
| 7 | 70 µg AC912005 | 0.557 | 0.112 | 0.141 |
| 8 | 70 µg AC912006 | 0.823 | 0.362 | 0.646 |
| 9 | 70 µg AC912007 | 0.580 | 0.215 | 0.342 |
| 10 | 70 µg AC912008 | 0.650 | 0.133 | 0.167 |
| 11 | 70 µg AC912009 | 0.576 | 0.069 | 0.078 |
| 12 | 70 µg AC912010 | 1.016 | 0.236 | 0.307 |
| 13 | 70 µg AC912011 | 0.742 | 0.065 | 0.071 |

As shown in Table 20, AC912006 demonstrated the greatest knockdown of hMAPT in the cortex, with AC912007 showing similar knockdown, AC912007 and AC912003 demonstrated the greatest knockdown in the hippocampus, and AC912005 demonstrated the greatest knockdown of hMAPT in the thoracic spinal cord.

Example 7. In Vivo Knockdown of MAPT in Transgenic PS19 Mice

On Study day 1, PS19 mice were injected with either 10 µL artificial cerebrospinal fluid (aCSF, obtained from a commercial supplier) or 10 µL of compound formulation at a concentration of either 3 mg/mL for groups, 2, 4, 6, 8, 10 and 12 or 7 mg/mL for groups 3, 5, 7, 9, 11, and 13 in aCSF, according to Table 21 below:

TABLE 21

Dosing groups for the mice of Example 7.

| Group ID | Animals dosed | AC Duplex Number |
|---|---|---|
| Group 1 (aCSF) | n = 4 | N/A |
| Group 2 30 µg AD13908 | n = 4 | AC912005 |
| Group 3 70 µg AD13908 | n = 4 | AC912005 |
| Group 4 30 µg AD13909 | n = 4 | AC912006 |
| Group 5 70 µg AD13909 | n = 4 | AC912006 |
| Group 6 30 µg AD13910 | n = 4 | AC912007 |
| Group 7 70 µg AD13910 | n = 4 | AC912007 |

TABLE 21-continued

Dosing groups for the mice of Example 7.

| Group ID | Animals dosed | AC Duplex Number |
|---|---|---|
| Group 8 30 µg AD13911 | n = 4 | AC912008 |
| Group 9 70 µg AD13911 | n = 4 | AC912008 |
| Group 10 30 µg AD13912 | n = 4 | AC912009 |
| Group 11 70 µg AD13912 | n = 4 | AC912009 |
| Group 12 30 µg AD13914 | n = 4 | AC912011 |
| Group 13 70 µg AD13914 | n = 4 | AC912011 |

Four (n=4) mice were dosed in each group. Mice were injected intracerebroventricularly on day 1. On day 8, mice were euthanized and the left half of the brain and thoracic spinal cord were collected and stored in 1000 NBF. Tissue samples were taken from the thoracic spinal cord, cortex, and hippocampus. Samples were analyzed by qPCR for MAPT mRNA knockdown. Average results for each group are shown in Table 22 below:

TABLE 22

Relative expression of MAPT mRNA in various tissues analyzed by qPCR for each of the dosing groups of Example 7.

| Group # | Description | Cortex Group Average (n = 4) | | | Hippocampus Group Average (n = 4) | | |
| --- | --- | --- | --- | --- | --- | --- | --- |
| | | Rel. Exp. | Error (Low) | Error (High) | Rel. Exp. | Error (Low) | Error (High) |
| 1 | aCSF | 1.000 | 0.103 | 0.115 | 1.000 | 0.214 | 0.272 |
| 2 | 30 µg AC912005 | 0.549 | 0.279 | 0.567 | 0.544 | 0.264 | 0.511 |
| 3 | 70 µg AC912005 | 0.397 | 0.073 | 0.090 | 0.369 | 0.060 | 0.071 |
| 4 | 30 µg AC912006 | 0.763 | 0.100 | 0.114 | 0.577 | 0.194 | 0.293 |
| 5 | 70 µg AC912006 | 0.771 | 0.194 | 0.259 | 0.435 | 0.055 | 0.063 |
| 6 | 30 µg AC912007 | 0.414 | 0.274 | 0.811 | 0.308 | 0.201 | 0.574 |
| 7 | 70 µg AC912007 | 0.469 | 0.160 | 0.243 | 0.329 | 0.176 | 0.377 |
| 8 | 30 µg AC912008 | 0.514 | 0.083 | 0.100 | 0.439 | 0.075 | 0.090 |
| 9 | 70 µg AC912008 | 0.409 | 0.152 | 0.242 | 0.250 | 0.105 | 0.181 |
| 10 | 30 µg AC912009 | 0.800 | 0.088 | 0.098 | 0.611 | 0.120 | 0.150 |
| 11 | 70 µg AC912009 | 0.374 | 0.150 | 0.249 | 0.281 | 0.062 | 0.080 |
| 12 | 30 µg AC912011 | 0.690 | 0.135 | 0.167 | 0.500 | 0.164 | 0.245 |
| 13 | 70 µg AC912011 | 0.574 | 0.099 | 0.120 | 0.503 | 0.143 | 0.200 |

| Group # | Description | Thoracic Spinal Cord Group Average (n = 4) | | |
| --- | --- | --- | --- | --- |
| | | Rel. Exp. | Error (Low) | Error (High) |
| 1 | aCSF | 1.000 | 0.181 | 0.220 |
| 2 | 30 µg AC912005 | 0.804 | 0.286 | 0.443 |
| 3 | 70 µg AC912005 | 0.427 | 0.061 | 0.072 |
| 4 | 30 µg AC912006 | 0.703 | 0.043 | 0.046 |
| 5 | 70 µg AC912006 | 0.429 | 0.137 | 0.200 |
| 6 | 30 µg AC912007 | 0.475 | 0.172 | 0.270 |
| 7 | 70 µg AC912007 | 0.468 | 0.058 | 0.066 |
| 8 | 30 µg AC912008 | 0.657 | 0.110 | 0.132 |
| 9 | 70 µg AC912008 | 0.260 | 0.103 | 0.170 |
| 10 | 30 µg AC912009 | 0.698 | 0.073 | 0.082 |
| 11 | 70 µg AC912009 | 0.390 | 0.128 | 0.190 |
| 12 | 30 µg AC912011 | 0.725 | 0.063 | 0.069 |
| 13 | 70 µg AC912011 | 0.533 | 0.096 | 0.117 |

As shown in Table 22, AC912008 demonstrated dose-dependent knockdown in all tissues while achieving the greatest knockdown in both the hippocampus and thoracic spinal cord at the 70 µg dose level.

Example 8. In Vivo Knockdown of MAPT in Transgenic PS19 Mice

On Study day 1, PS19 mice were injected with either 10 µL artificial cerebrospinal fluid (aCSF, obtained from a commercial supplier) or 10 µL of compound formulation at a concentration of 5 mg/mL for groups 2-9 in aCSF, according to Table 23 below:

TABLE 23

Dosing groups for the mice of Example 8.

| Group ID | Animals dosed |
| --- | --- |
| Group 1 (aCSF) | n = 4 |
| Group 2 50 µg AC912008 | n = 4 |
| Group 3 50 µg AC912669 | n = 4 |
| Group 4 50 µg AC912670 | n = 4 |
| Group 5 50 µg AC912671 | n = 4 |
| Group 6 50 µg AC912672 | n = 4 |
| Group 7 50 µg AC912673 | n = 4 |
| Group 8 50 µg AC912674 | n = 4 |
| Group 9 50 µg AC912675 | n = 4 |

Four (n=4) mice were dosed in each group. Mice were injected intracerebroventricularly on day 1. On day 8, mice were euthanized and the left half of the brain and thoracic spinal cord were collected and stored in 1000 NBF. Tissue samples were taken from the thoracic spinal cord, cortex, and hippocampus. Samples were analyzed by qPCR for MAPT mRNA knockdown. Average results for each group are shown in Table 24 below:

TABLE 24

Relative expression of MAPT mRNA in various tissues analyzed by qPCR for each of the dosing groups of Example 8.

| | | Cortex Group Average (n = 4) | | | Hippocampus Group Average (n = 4) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.110 | 0.123 | 1.000 | 0.167 | 0.200 |
| 2 | 50 μg AC912008 | 0.536 | 0.093 | 0.113 | 0.722 | 0.164 | 0.212 |
| 3 | 50 μg AC912669 | 0.423 | 0.060 | 0.069 | 0.505 | 0.183 | 0.287 |
| 4 | 50 μg AC912670 | 0.406 | 0.047 | 0.053 | 0.512 | 0.116 | 0.150 |
| 5 | 50 μg AC912671 | 0.311 | 0.097 | 0.141 | 0.418 | 0.202 | 0.393 |
| 6 | 50 μg AC912672 | 0.499 | 0.085 | 0.102 | 0.536 | 0.115 | 0.147 |
| 7 | 50 μg AC912673 | 0.481 | 0.150 | 0.218 | 0.554 | 0.221 | 0.367 |
| 8 | 50 μg AC912674 | 0.548 | 0.096 | 0.117 | 0.859 | 0.244 | 0.340 |
| 9 | 50 μg AC912675 | 0.535 | 0.177 | 0.264 | 0.641 | 0.200 | 0.291 |

| | | Thoracic Spinal Cord Group Average (n = 4) | | |
|---|---|---|---|---|
| Group # | Description | Rel. Exp. | Error (Low) | Error (High) |
| 1 | aCSF | 1.000 | 0.082 | 0.090 |
| 2 | 50 μg AC912008 | 0.497 | 0.081 | 0.097 |
| 3 | 50 μg AC912669 | 0.375 | 0.048 | 0.056 |
| 4 | 50 μg AC912670 | 0.379 | 0.057 | 0.067 |
| 5 | 50 μg AC912671 | 0.374 | 0.061 | 0.073 |
| 6 | 50 μg AC912672 | 0.502 | 0.089 | 0.108 |
| 7 | 50 μg AC912673 | 0.461 | 0.047 | 0.052 |
| 8 | 50 μg AC912674 | 0.443 | 0.052 | 0.059 |
| 9 | 50 μg AC912675 | 0.463 | 0.149 | 0.219 |

As shown in Table 24, AC912671 demonstrated the greatest knockdown in all tissues.

Example 9. In Vivo Knockdown of MAPT in Transgenic PS19 Mice

On Study day 1, PS19 mice were injected with either 10 μL artificial cerebrospinal fluid (aCSF, obtained from a commercial supplier) or 10 μL of compound formulation at a concentration of 5 mg/mL for groups 2-8 in aCSF, according to Table 25 below:

TABLE 25

Dosing groups for the mice of Example 9.

| Group ID | Animals dosed |
|---|---|
| Group 1 (aCSF) | n = 4 |
| Group 2 50 μg AC912671 | n = 4 |
| Group 3 50 μg AC003990 | n = 4 |
| Group 4 50 μg AC003991 | n = 4 |
| Group 5 50 μg AC003992 | n = 4 |
| Group 6 50 μg AC003993 | n = 4 |
| Group 7 50 μg AC003994 | n = 4 |
| Group 8 50 μg AC003995 | n = 4 |

Four (n=4) mice were dosed in each group. Mice were injected intracerebroventricularly on day 1. On day 8, mice were euthanized and the left half of the brain and thoracic spinal cord were collected and stored in 10% NBF. Tissue samples were taken from the thoracic spinal cord, cortex, and hippocampus. Samples were analyzed by qPCR for MAPT mRNA knockdown. Average results for each group are shown in Table 26 below:

TABLE 26

Relative expression of MAPT mRNA in various tissues analyzed by qPCR.

| | | Cortex Group Average (n = 4) | | | Hippocampus Group Average (n = 4) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.180 | 0.220 | 1.000 | 0.134 | 0.155 |
| 2 | 50 μg AC912671 | 0.453 | 0.129 | 0.180 | 0.319 | 0.025 | 0.027 |
| 3 | 50 μg AC003990 | 0.278 | 0.075 | 0.104 | 0.147 | 0.042 | 0.059 |
| 4 | 50 μg AC003991 | 0.745 | 0.186 | 0.248 | 0.538 | 0.142 | 0.193 |
| 5 | 50 μg AC003992 | 0.409 | 0.038 | 0.042 | 0.290 | 0.082 | 0.115 |
| 6 | 50 μg AC003993 | 1.046 | 0.250 | 0.329 | 0.887 | 0.251 | 0.349 |
| 7 | 50 μg AC003994 | 0.455 | 0.089 | 0.111 | 0.356 | 0.061 | 0.074 |

TABLE 26-continued

Relative expression of MAPT mRNA in various tissues analyzed by qPCR.

| 8 | 50 µg AC003995 | 0.393 | 0.096 | 0.127 | 0.308 | 0.118 | 0.192 |

| | | Thoracic Spinal Cord Group Average (n = 4) | | |
|---|---|---|---|---|
| Group # | Description | Rel. Exp. | Error (Low) | Error (High) |
| 1 | aCSF | 1.000 | 0.111 | 0.125 |
| 2 | 50 µg AC912671 | 0.387 | 0.130 | 0.196 |
| 3 | 50 µg AC003990 | 0.336 | 0.083 | 0.111 |
| 4 | 50 µg AC003991 | 0.800 | 0.103 | 0.118 |
| 5 | 50 µg AC003992 | 0.422 | 0.054 | 0.063 |
| 6 | 50 µg AC003993 | 0.984 | 0.190 | 0.235 |
| 7 | 50 µg AC003994 | 0.358 | 0.111 | 0.160 |
| 8 | 50 µg AC003995 | 0.402 | 0.100 | 0.132 |

As shown in Table 26, AC003990 demonstrated the greatest knockdown in all tissues.

Example 10. In Vivo Knockdown of MAPT in Transgenic PS19 Mice

On Study day 1, PS19 mice were injected with either 10 µL artificial cerebrospinal fluid (aCSF, obtained from a commercial supplier) or 10 µL of compound formulation at a concentration of 30 mg/mL for groups 2-7 in aCSF, according to Table 27 below:

TABLE 27

Dosing groups for the mice of Example 10.

| Group ID | Animals dosed |
|---|---|
| Group 1 (aCSF) | n = 4 |
| Group 2 300 µg AC912671 | n = 4 |
| Group 3 300 µg AC004123 | n = 4 |
| Group 4 300 µg AC004124 | n = 4 |
| Group 5 300 µg AC004125 | n = 4 |
| Group 6 300 µg AC004126 | n = 4 |
| Group 7 300 µg AC004130 | n = 4 |

Four (n=4) mice were dosed in each group. Mice were injected intracerebroventricularly on day 1. On day 15, mice were euthanized and the left half of the brain and thoracic spinal cord were collected and stored in 10% NBF. Tissue samples were taken from the thoracic spinal cord, temporal cortex, and hippocampus. Samples were analyzed by qPCR for MAPT mRNA knockdown. Average results for each group are shown in Table 28 below:

TABLE 28

Relative expression of MAPT mRNA in various tissues analyzed by qPCR.

| | | Temporal Cortex Group Average (n = 4) | | | Hippocampus Group Average (n = 4) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.175 | 0.212 | 1.000 | 0.181 | 0.222 |
| 2 | 300 µg AC912671 | 0.178 | 0.055 | 0.080 | 0.161 | 0.040 | 0.054 |
| 3 | 300 µg AC004123 | 0.121 | 0.030 | 0.040 | 0.099 | 0.011 | 0.013 |
| 4 | 300 µg AC004124 | 0.207 | 0.029 | 0.034 | 0.210 | 0.042 | 0.053 |
| 5 | 300 µg AC004125 | 0.173 | 0.048 | 0.067 | 0.169 | 0.042 | 0.055 |
| 6 | 300 µg AC004126 | 0.160 | 0.028 | 0.034 | 0.167 | 0.037 | 0.047 |
| 7 | 300 µg AC004130 | 0.229 | 0.052 | 0.067 | 0.240 | 0.074 | 0.106 |

| | | Thoracic Spinal Cord Group Average (n = 4) | | |
|---|---|---|---|---|
| Group # | Description | Rel. Exp. | Error (Low) | Error (High) |
| 1 | aCSF | 1.000 | 0.170 | 0.206 |
| 2 | 300 µg AC912671 | 0.345 | 0.181 | 0.380 |
| 3 | 300 µg AC004123 | 0.229 | 0.042 | 0.051 |
| 4 | 300 µg AC004124 | 0.228 | 0.027 | 0.031 |
| 5 | 300 µg AC004125 | 0.242 | 0.023 | 0.026 |
| 6 | 300 µg AC004126 | 0.238 | 0.028 | 0.031 |
| 7 | 300 µg AC004130 | 0.427 | 0.031 | 0.033 |

As shown in Table 28, AC004123 demonstrated the greatest knockdown in the temporal cortex and hippocampus, and AC004124 demonstrated the greatest knockdown in the thoracic spinal cord on day 15.

Example 11. In Vivo Knockdown of MAPT in Transgenic PS19 Mice

On Study day 1, PS19 mice were injected with either 10 µL artificial cerebrospinal fluid (aCSF, obtained from a commercial supplier) or 10 µL of compound formulation at a concentration of 30 mg/mL for groups 2-7 in aCSF, according to Table 29 below:

TABLE 29

Dosing groups for the mice of Example 11.

| Group ID | Animals dosed |
|---|---|
| Group 1 (aCSF) | n = 4 |
| Group 2 300 µg AC912671 | n = 4 |
| Group 3 300 µg AC004123 | n = 4 |
| Group 4 300 µg AC004124 | n = 4 |
| Group 5 300 µg AC004125 | n = 4 |
| Group 6 300 µg AC004126 | n = 4 |
| Group 7 300 µg AC004130 | n = 4 |

Four (n=4) mice were dosed in each group. Mice were injected intracerebroventricularly on day 1. On day 29, mice were euthanized and the left half of the brain and thoracic spinal cord were collected and stored in 1000 NBF. Tissue samples were taken from the thoracic spinal cord, temporal cortex, and hippocampus. Samples were analyzed by qPCR for MAPT mRNA knockdown. Average results for each group are shown in Table 30 below:

TABLE 30

Relative expression of MAPT mRNA in various tissues analyzed by qPCR for each of the dosing groups of Example 11.

| Group # | Description | Temporal Cortex Group Average (n = 4) | | | Hippocampus Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.421 | 0.726 | 1.000 | 0.405 | 0.679 |
| 2 | 300 µg AC912671 | 0.235 | 0.078 | 0.117 | 0.284 | 0.143 | 0.290 |
| 3 | 300 µg AC004123 | 0.190 | 0.096 | 0.195 | 0.134 | 0.064 | 0.122 |
| 4 | 300 µg AC004124 | 0.139 | 0.034 | 0.045 | 0.131 | 0.060 | 0.112 |
| 5 | 300 µg AC004125 | 0.304 | 0.158 | 0.329 | 0.356 | 0.197 | 0.444 |
| 6 | 300 µg AC004126 | 0.154 | 0.056 | 0.087 | 0.269 | 0.100 | 0.158 |
| 7 | 300 µg AC004130 | 0.113 | 0.064 | 0.149 | 0.310 | 0.115 | 0.182 |

| Group # | Description | Thoracic Spinal Cord Group Average (n = 4) | | |
|---|---|---|---|---|
| | | Rel. Exp. | Error (Low) | Error (High) |
| 1 | aCSF | 1.000 | 0.357 | 0.555 |
| 2 | 300 µg AC912671 | 0.256 | 0.163 | 0.447 |
| 3 | 300 µg AC004123 | 0.367 | 0.234 | 0.646 |
| 4 | 300 µg AC004124 | 0.367 | 0.137 | 0.220 |
| 5 | 300 µg AC004125 | 0.235 | 0.124 | 0.261 |
| 6 | 300 µg AC004126 | 0.389 | 0.157 | 0.264 |
| 7 | 300 µg AC004130 | 0.318 | 0.119 | 0.191 |

As shown in Table 30, AC004130 demonstrated the greatest knockdown in the temporal cortex, AC004124 demonstrated the greatest knockdown in the hippocampus, and AC004125 demonstrated the greatest knockdown in the thoracic spinal cord.

Example 12. In Vivo Knockdown of MAPT in Transgenic PS19 Mice

On Study day 1, PS19 mice were injected with either 10 µL artificial cerebrospinal fluid (aCSF, obtained from a commercial supplier) or 10 µL of compound formulation at a concentration of 30 mg/mL for groups 2-7 in aCSF, according to Table 31 below:

TABLE 31

Dosing groups for the mice of Example 12.

| Group ID | Animals dosed |
|---|---|
| Group 1 (aCSF) | n = 4 |
| Group 2 300 µg AC912671 | n = 4 |
| Group 3 300 µg AC004123 | n = 4 |
| Group 4 300 µg AC004124 | n = 4 |
| Group 5 300 µg AC004125 | n = 4 |
| Group 6 300 µg AC004126 | n = 4 |
| Group 7 300 µg AC004130 | n = 4 |

Four (n=4) mice were dosed in each group. Mice were injected intracerebroventricularly on day 1. On day 57, mice were euthanized and the left half of the brain and thoracic spinal cord were collected and stored in 10% NBF. Tissue samples were taken from the frontal cortex, temporal cortex, thoracic spinal cord, and hippocampus. Samples were analyzed by qPCR for MAPT mRNA knockdown. Average results for each group are shown in Table 32 below:

TABLE 32

Relative expression of MAPT mRNA in various tissues analyzed by qPCR.

| Group # | Description | Frontal Cortex Group Average (n = 4) | | | Temporal Cortex Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.212 | 0.268 | 1.000 | 0.181 | 0.220 |
| 2 | 300 ug AC912671 | 0.336 | 0.070 | 0.088 | 0.267 | 0.057 | 0.073 |
| 3 | 300 ug AC004123 | 0.169 | 0.082 | 0.157 | 0.135 | 0.068 | 0.136 |
| 4 | 300 ug AC004124 | 0.228 | 0.089 | 0.145 | 0.221 | 0.086 | 0.140 |
| 5 | 300 ug AC004125 | 0.133 | 0.077 | 0.184 | 0.129 | 0.081 | 0.220 |
| 6 | 300 ug AC004126 | 0.287 | 0.101 | 0.157 | 0.324 | 0.154 | 0.294 |
| 7 | 300 ug AC004130 | 0.215 | 0.038 | 0.046 | 0.252 | 0.084 | 0.127 |

| Group # | Description | Thoracic Spinal Cord Group Average (n = 4) | | | Hippocampus Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.042 | 0.044 | 1.000 | 0.156 | 0.184 |
| 2 | 300 ug AC912671 | 0.231 | 0.028 | 0.032 | 0.198 | 0.053 | 0.073 |
| 3 | 300 ug AC004123 | 0.300 | 0.088 | 0.124 | 0.077 | 0.038 | 0.075 |
| 4 | 300 ug AC004124 | 0.286 | 0.144 | 0.291 | 0.095 | 0.020 | 0.026 |
| 5 | 300 ug AC004125 | 0.145 | 0.080 | 0.178 | 0.101 | 0.053 | 0.113 |
| 6 | 300 ug AC004126 | 0.319 | 0.097 | 0.139 | 0.260 | 0.100 | 0.163 |
| 7 | 300 ug AC004130 | 0.281 | 0.032 | 0.036 | 0.157 | 0.044 | 0.061 |

As shown in Table 32, AC004125 demonstrated the greatest knockdown in the frontal cortex, temporal cortex, and thoracic spinal cord. AC004123 demonstrated the greatest knockdown in the hippocampus at day 57.

Example 13. In Vivo Knockdown of MAPT in Transgenic PS19 Mice

On Study day 1, PS19 mice were injected with either 10 μL artificial cerebrospinal fluid (aCSF, obtained from a commercial supplier) or 10 μL of compound formulation at a concentration of 30 mg/mL for groups 2-7 in aCSF, according to Table 33 below:

TABLE 33

Dosing groups for the mice of Example 13.

| Group ID | Animals dosed |
|---|---|
| Group 1 (aCSF) | n = 4 |
| Group 2 300 μg AC912671 | n = 4 |

TABLE 33-continued

Dosing groups for the mice of Example 13.

| Group ID | Animals dosed |
|---|---|
| Group 3 300 μg AC004123 | n = 4 |
| Group 4 300 μg AC004124 | n = 4 |
| Group 5 300 μg AC004125 | n = 4 |
| Group 6 300 μg AC004126 | n = 4 |
| Group 7 300 μg AC004130 | n = 4 |

Four (n=4) mice were dosed in each group. Mice were injected intracerebroventricularly on day 1. On day 85, mice were euthanized and the left half of the brain and thoracic spinal cord were collected and stored in 10% NBF. Tissue samples were taken from the frontal cortex, temporal cortex, thoracic spinal cord, and hippocampus. Samples were analyzed by qPCR for MAPT mRNA knockdown. Average results for each group are shown in Table 34 below:

TABLE 34

Relative expression of MAPT mRNA in various tissues analyzed by qPCR.

| Group # | Description | Frontal Cortex Group Average (n = 4) | | | Temporal Cortex Group Average (n = 4) | | |
|---|---|---|---|---|---|---|---|
| | | Rel. Exp. | Error (Low) | Error (High) | Rel. Exp. | Error (Low) | Error (High) |
| 1 | aCSF | 1.000 | 0.173 | 0.209 | 1.000 | 0.201 | 0.252 |
| 2 | 300 ug AC912671 | 0.640 | 0.190 | 0.271 | 0.523 | 0.118 | 0.152 |
| 3 | 300 ug AC004123 | 0.258 | 0.079 | 0.113 | 0.333 | 0.046 | 0.053 |
| 4 | 300 ug AC004124 | 0.221 | 0.092 | 0.158 | 0.218 | 0.120 | 0.269 |
| 5 | 300 ug AC004125 | 0.290 | 0.096 | 0.144 | 0.231 | 0.135 | 0.324 |

TABLE 34-continued

Relative expression of MAPT mRNA in various tissues analyzed by qPCR.

| | | | | | | | |
|---|---|---|---|---|---|---|---|
| 6 | 300 ug AC004126 | 0.358 | 0.175 | 0.340 | 0.619 | 0.183 | 0.261 |
| 7 | 300 ug AC004130 | 0.281 | 0.113 | 0.190 | 0.286 | 0.142 | 0.282 |

| | | Thoracic Spinal Cord Group Average (n = 4) | | | Hippocampus Group Average (n = 4) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.069 | 0.074 | 1.000 | 0.170 | 0.205 |
| 2 | 300 ug AC912671 | 0.579 | 0.160 | 0.221 | 0.366 | 0.128 | 0.196 |
| 3 | 300 ug AC004123 | 0.423 | 0.057 | 0.066 | 0.351 | 0.087 | 0.116 |
| 4 | 300 ug AC004124 | 0.365 | 0.079 | 0.101 | 0.203 | 0.090 | 0.163 |
| 5 | 300 ug AC004125 | 0.526 | 0.060 | 0.068 | 0.188 | 0.084 | 0.153 |
| 6 | 300 ug AC004126 | 0.463 | 0.101 | 0.130 | 0.510 | 0.195 | 0.317 |
| 7 | 300 ug AC004130 | 0.353 | 0.041 | 0.047 | 0.218 | 0.110 | 0.222 |

As shown in Table 34, AC004124 demonstrated the greatest knockdown in the frontal cortex, temporal cortex, AC004130 demonstrated the greatest knockdown in the thoracic spinal cord, and AC004125 demonstrated the greatest knockdown in the hippocampus at day 85.

Example 14. In Vivo Knockdown of MAPT in Transgenic PS19 Mice

On Study day 1, PS19 mice were injected with either 10 μL artificial cerebrospinal fluid (aCSF, obtained from a commercial supplier) or 10 μL of compound formulation at a concentration of 0.3 mg/mL for groups 2, 7, 12 and 17, 1 mg/mL for groups 3, 8, 13 and 18, 3 mg/mL for groups 4, 9, 14 and 19, 10 mg/mL for groups 5, 10, 15 and 20, and 30 mg/mL for groups 6, 11, 16, and 21 in aCSF, according to Table 35 below:

TABLE 35

Dosing groups for the mice of Example 14.

| Group ID | Animals dosed |
|---|---|
| Group 1 (aCSF) | n = 4 |
| Group 2 3 μg AC912671 | n = 4 |
| Group 3 10 μg AC912671 | n = 4 |
| Group 4 30 μg AC912671 | n = 4 |
| Group 5 100 μg AC912671 | n = 4 |

TABLE 35-continued

Dosing groups for the mice of Example 14.

| Group ID | Animals dosed |
|---|---|
| Group 6 300 μg AC912671 | n = 4 |
| Group 7 3 μg AC004123 | n = 4 |
| Group 8 10 μg AC004123 | n = 4 |
| Group 9 30 μg AC004123 | n = 4 |
| Group 10 100 μg AC004123 | n = 4 |
| Group 11 300 μg AC004123 | n = 4 |
| Group 12 3 μg AC004125 | n = 4 |
| Group 13 10 μg AC004125 | n = 4 |
| Group 14 30 μg AC004125 | n = 4 |
| Group 15 100 μg AC004125 | n = 3 |
| Group 16 300 μg AC004125 | n = 4 |
| Group 17 3 μg AC004130 | n = 4 |
| Group 18 10 μg AC004130 | n = 4 |
| Group 19 30 μg AC004130 | n = 4 |
| Group 20 100 μg AC004130 | n = 4 |
| Group 21 300 μg AC004130 | n = 4 |

Four (n=4) mice were dosed in each group except for group 15, in which three (n=3) mice were dosed. Mice were injected intracerebroventricularly on day 1. On day 15, mice were euthanized and the left half of the brain and thoracic spinal cord were collected and stored in 10% NBF. Tissue samples were taken from the thoracic spinal cord, cortex, and hippocampus. Samples were analyzed by qPCR for MAPT mRNA knockdown. Average results for each group are shown in Table 36 below:

TABLE 36

Relative expression of MAPT mRNA in various tissues analyzed by qPCR.

| | | Cortex Group Average (n = 4) | | | Hippocampus Group Average (n = 4) | | |
|---|---|---|---|---|---|---|---|
| Group # | Description | Rel. Exp. | Error (Low) | Error (High) | Rel. Exp. | Error (Low) | Error (High) |
| 1 | aCSF | 1.000 | 0.148 | 0.174 | 1.000 | 0.202 | 0.254 |
| 2 | 3 μg AC912671 | 0.897 | 0.330 | 0.523 | 0.756 | 0.257 | 0.390 |
| 3 | 10 μg AC912671 | 0.908 | 0.142 | 0.168 | 0.770 | 0.161 | 0.204 |
| 4 | 30 μg AC912671 | 0.502 | 0.215 | 0.376 | 0.343 | 0.143 | 0.244 |
| 5 | 100 μg AC912671 | 0.232 | 0.083 | 0.130 | 0.182 | 0.080 | 0.144 |
| 6 | 300 μg AC912671 | 0.219 | 0.100 | 0.185 | 0.152 | 0.058 | 0.093 |
| 7 | 3 μg AC004123 | 0.771 | 0.250 | 0.370 | 0.762 | 0.341 | 0.618 |
| 8 | 10 μg AC004123 | 0.662 | 0.211 | 0.311 | 0.530 | 0.142 | 0.195 |
| 9 | 30 μg AC004123 | 0.438 | 0.141 | 0.208 | 0.359 | 0.140 | 0.230 |
| 10 | 100 μg AC004123 | 0.373 | 0.157 | 0.270 | 0.261 | 0.102 | 0.166 |
| 11 | 300 μg AC004123 | 0.137 | 0.065 | 0.124 | 0.114 | 0.069 | 0.176 |
| 12 | 3 μg AC004125 | 0.565 | 0.127 | 0.163 | 0.636 | 0.148 | 0.193 |
| 13 | 10 μg AC004125 | 0.596 | 0.155 | 0.209 | 0.465 | 0.175 | 0.281 |

TABLE 36-continued

Relative expression of MAPT mRNA in various tissues analyzed by qPCR.

| 14 | 30 µg AC004125 | 0.421 | 0.154 | 0.244 | 0.311 | 0.072 | 0.093 |
| 15 | 100 µg AC004125 | 0.182 | 0.045 | 0.060 | 0.126 | 0.024 | 0.030 |
| 16 | 300 µg AC004125 | 0.177 | 0.051 | 0.072 | 0.144 | 0.041 | 0.057 |
| 17 | 3 µg AC004130 | 0.658 | 0.291 | 0.523 | 0.698 | 0.294 | 0.508 |
| 18 | 10 µg AC004130 | 0.816 | 0.104 | 0.119 | 0.684 | 0.075 | 0.084 |
| 19 | 30 µg AC004130 | 0.428 | 0.093 | 0.118 | 0.435 | 0.151 | 0.232 |
| 20 | 100 µg AC004130 | 0.181 | 0.021 | 0.024 | 0.257 | 0.050 | 0.062 |
| 21 | 300 µg AC004130 | 0.200 | 0.113 | 0.258 | 0.186 | 0.103 | 0.230 |

| | | Thoracic Spinal Cord Group Average (n = 4) | | |
|---|---|---|---|---|
| Group # | Description | Rel. Exp. | Error (Low) | Error (High) |
| 1 | aCSF | 1.000 | 0.117 | 0.132 |
| 2 | 3 µg AC912671 | 0.982 | 0.172 | 0.208 |
| 3 | 10 µg AC912671 | 0.880 | 0.114 | 0.131 |
| 4 | 30 µg AC912671 | 0.504 | 0.154 | 0.221 |
| 5 | 100 µg AC912671 | 0.212 | 0.068 | 0.100 |
| 6 | 300 µg AC912671 | 0.251 | 0.103 | 0.175 |
| 7 | 3 µg AC004123 | 0.862 | 0.141 | 0.168 |
| 8 | 10 µg AC004123 | 0.784 | 0.050 | 0.053 |
| 9 | 30 µg AC004123 | 0.550 | 0.063 | 0.071 |
| 10 | 100 µg AC004123 | 0.276 | 0.034 | 0.039 |
| 11 | 300 µg AC004123 | 0.204 | 0.095 | 0.176 |
| 12 | 3 µg AC004125 | 0.709 | 0.156 | 0.199 |
| 13 | 10 µg AC004125 | 0.868 | 0.196 | 0.252 |
| 14 | 30 µg AC004125 | 0.511 | 0.111 | 0.143 |
| 15 | 100 µg AC004125 | 0.285 | 0.018 | 0.019 |
| 16 | 300 µg AC004125 | 0.234 | 0.084 | 0.131 |
| 17 | 3 µg AC004130 | 0.901 | 0.136 | 0.161 |
| 18 | 10 µg AC004130 | 0.925 | 0.148 | 0.176 |
| 19 | 30 µg AC004130 | 0.653 | 0.142 | 0.181 |
| 20 | 100 µg AC004130 | 0.390 | 0.199 | 0.406 |
| 21 | 300 µg AC004130 | 0.421 | 0.088 | 0.112 |

As shown in Table 36, each group showed a general dose-dependent response to the administered RNAi agent. AC004125 demonstrated deep knockdown in the cortex and hippocampus, especially at the 100 µg dose level.

Example 15. In Vivo Knockdown of MAPT in in Cynomolgus Monkeys

On Study day 1, cynomolgus monkeys were injected with either artificial cerebrospinal fluid (aCSF, obtained from a commercial supplier) or a compound formulation containing 15 mg of a MAPT RNAi agent formulated in aCSF according to Table 37 below:

TABLE 37

Dosing groups for the non-human primates of Example 15.

| Group ID | Animals dosed |
|---|---|
| Group 1 (aCSF) | n = 4 |
| Group 2 15 mg AC005033 | n = 6 |
| Group 3 15 mg AC004265 | n = 6 |
| Group 4 15 mg AC912671 | n = 7 |
| Group 5 15 mg AC004123 | n = 4 |
| Group 6 15 mg AC004125 | n = 7 |
| Group 7 15 mg AC004130 | n = 6 |

Four (n=4) monkeys were dosed in group 1, six (n=6) monkeys were dosed in groups 2, 3, and 7, and seven (n=7) monkeys were dosed in groups 3 and 6. Monkeys were injected intrathecally on day 1. On study day 85, animals from each group were euthanized and brain and spinal cord tissue was collected from each animal.

Intrathecal injection in NHPs is a challenging procedure and mis-dosing is commonly observed due to the limited space and accessibility leading to improper placement of the injection needle and leakage of the test article. To adjust for mis-dosing in analysis of protein and expression levels, mis-dosing criteria was defined such that improperly dosed animals were excluded.

The mis-dosing criteria was solely based on tissue distribution of siRNA compound. Cynomolgus monkeys were determined mis-dosed and excluded from the analysis, if approximately 5000 or more of the brain tissue regions analyzed have compound concentrations lower than 25% of group mean. Out of the overall thirty-six (36) NHP which received test article, ten (10) animals were identified as mis-dosed and the protein expression level data were excluded from the analysis. Two animals were excluded from Group 2, five animals were excluded from group 3, four animals were excluded from group 4, two animals were excluded from group 5, three animals were excluded from group 6, and two animals were excluded from group 7 for misdosing.

Samples were analyzed by qPCR for MAPT mRNA knockdown. Samples were analyzed by JESS for protein knockdown. Average mRNA knockdown for frontal cortex, temporal cortex, hippocampus and thoracic spinal cord for each group, relative to Group 1, are shown in Table 42 below:

TABLE 38

Relative expression of MAPT mRNA in various tissues analyzed by qPCR.

| Group # | Description | Frontal Cortex Group Average | | | Temporal Cortex Group Average | | |
|---|---|---|---|---|---|---|---|
| | | Rel. Exp. | Error (Low) | Error (High) | Rel. Exp. | Error (Low) | Error (High) |
| 1 | aCSF | 1.000 | 0.559 | 1.269 | 1.000 | 0.240 | 0.317 |
| 2 | 15 mg AC005033 | 1.365 | 0.625 | 1.153 | 0.803 | 0.325 | 0.546 |
| 3 | 15 mg AC004265 | 2.079 | 0.523 | 0.700 | 1.207 | 0.630 | 1.318 |
| 4 | 15 mg AC912671 | 1.201 | 0.541 | 0.985 | 0.822 | 0.475 | 1.128 |
| 5 | 15 mg AC004123 | 0.502 | 0.241 | 0.463 | 0.468 | 0.205 | 0.366 |
| 6 | 15 mg AC004125 | 0.936 | 0.403 | 0.709 | 0.481 | 0.215 | 0.387 |
| 7 | 15 mg AC004130 | 0.976 | 0.300 | 0.434 | 0.641 | 0.252 | 0.415 |

| Group # | Description | Thoracic Spinal Cord Group Average | | | Hippocampus Group Average | | |
|---|---|---|---|---|---|---|---|
| | | Rel. Exp. | Error (Low) | Error (High) | Rel. Exp. | Error (Low) | Error (High) |
| 1 | aCSF | 1.000 | 0.190 | 0.234 | 1.000 | 0.147 | 0.173 |
| 2 | 15 mg AC005033 | 0.335 | 0.136 | 0.229 | 1.465 | 0.451 | 0.652 |
| 3 | 15 mg AC004265 | 0.685 | 0.227 | 0.340 | 1.821 | 0.502 | 0.694 |
| 4 | 15 mg AC912671 | 0.415 | 0.219 | 0.461 | 0.980 | 0.421 | 0.739 |
| 5 | 15 mg AC004123 | 0.165 | 0.110 | 0.333 | 0.801 | 0.341 | 0.593 |
| 6 | 15 mg AC004125 | 0.203 | 0.110 | 0.242 | 0.861 | 0.249 | 0.350 |
| 7 | 15 mg AC004130 | 0.447 | 0.191 | 0.333 | 1.029 | 0.314 | 0.452 |

Figure 3:
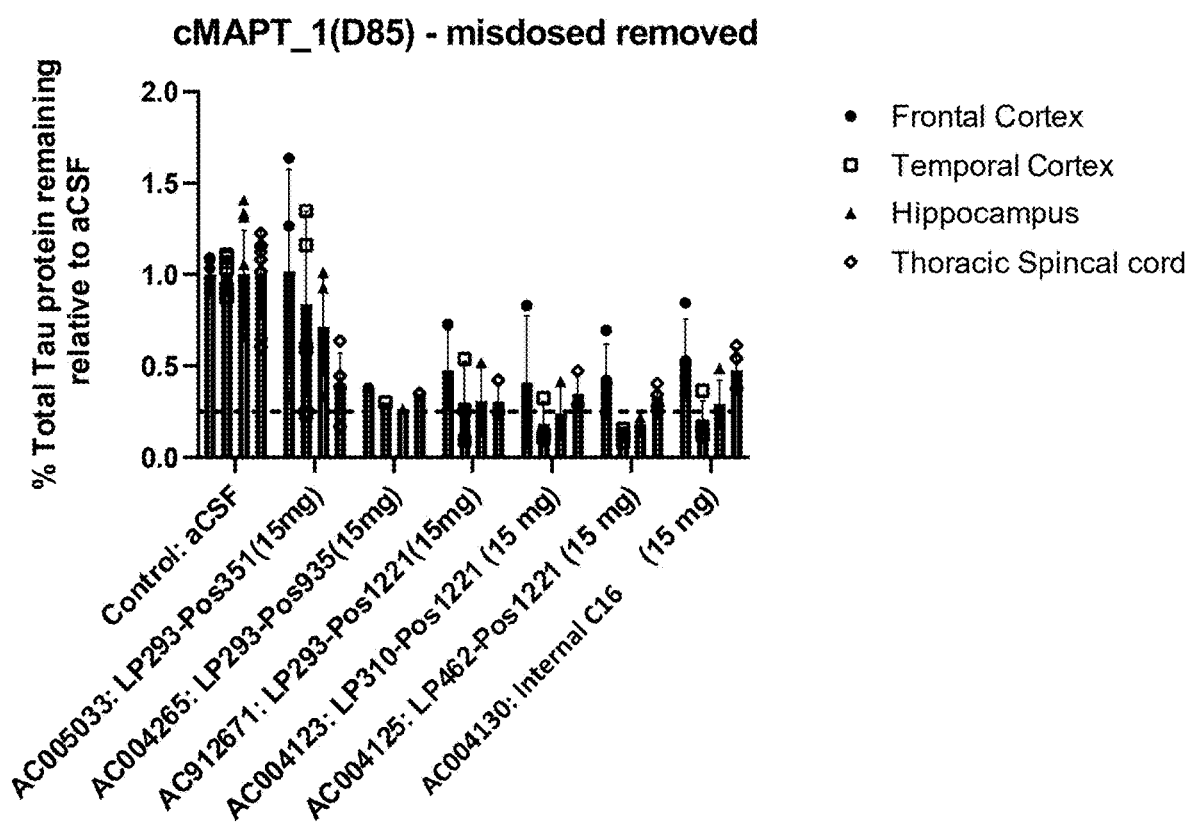
FIG. 3 Depicts the knockdown of MAPT protein in hippocampus, frontal cortex, temporal cortex, and thoracic spinal cord in cynomolgus monkeys administered MAPT RNAi agents according to the study described in Example 15.

Average protein knockdown for frontal cortex, temporal cortex, hippocampus and thoracic spinal cord for each group, relative to Group 1, are shown in FIG. 3.

Protein analysis by JESS shows that unexpectedly high knockdown was observed in the tissues of animals dosed in group 6 (AC004125).

Example 16. In Vivo Administration of MAPT RNAi Agents in Cynomolgus Monkeys

MAPT RNAi agents were evaluated in vivo in Cynomolgus monkeys. On Days 1, 8, and 15, four (n=4) male Cynomolgus monkeys for each test group were dosed with MAPT RNAi agents formulated in PBS at 3.0 mg/kg (adjusted for individual animal body weight), 2.0 ml/kg dose volume, at 1.5 mg/ml dose concentration, or dosed with PBS. Each dose was administered via subcutaneous (SC) injection, and each dose was administered based on each respective animal's most recent body weight. The dosing was in accordance with the following Table 39.

TABLE 39

Dosing for Cynomolgus monkeys of Example 16.

| Group ID, Dose (RNAi Agent) | Dosing Route | Sacrifice Day | # of Animals (n=) |
|---|---|---|---|
| 1. PBS | SC Injection on Day 1, 8, 15 | Day 43 | n = 4 |
| 2. 3.0 mg/kg AC009806 | SC Injection on Day 1, 8, 15 | Day 43 | n = 4 |
| 3. 3.0 mg/kg AC007414 | SC Injection on Day 1, 8, 15 | Day 43 | n = 4 |

The test animals were male, naïve, Cynomolgus monkeys (*Macaca fascicularis*). The test animals were acclimated to laboratory housing, per facility and acclimation standard operating procedures, for at least 3 days prior to the initiation of dosing. The test animals were randomized and assigned to groups using a computer-based procedure prior to transfer into the study.

Each animal from Groups 1-3 was dosed on Day 1, 8, and 15. The RNAi agent test articles were administered via subcutaneous (SC) administration with a syringe and needle in the mid-scapular region. Dose sites were shaved before dosing and remarked as necessary throughout the study. Dose one (on Day 1) was delivered to the left scapular region, dose two (on Day 8) was delivered to the right scapular region, and dose three (on Day 15) was delivered to the left scapular region. Each subcutaneous dose was delivered using a syringe with 23-25-gauge needle.

The test animals' individual body weights were recorded once pre-treatment Day −7, and then weekly through the duration of the study, and once prior to necropsy.

Cerebrospinal fluid (CSF), ~1.0 mL, was collected on Day −7 and on day of necropsy for all Groups. At Day 43, the animals were euthanized. From the test animals, the following tissues were collected: left and right brain hemisphere, spinal cord, dorsal root ganglion (DRG).

MAPT mRNA transcript expression was analyzed via qPCR in the tissues, with cPPIB as endogenous control gene, normalized to Group 1 cynos dosed with PBS. The MAPT mRNA transcript expression data is shown in the following Table 40.

TABLE 40

MAPT mRNA expression in cyno tissues.

| | | Day 43 | | | |
| --- | --- | --- | --- | --- | --- |
| | | Frontal Cortex | | Temporal Cortex | |
| Group ID | Sac Day | Rel. Exp. MAPT | Std. Dev +/− | Rel. Exp. MAPT | Std. Dev +/− |
| 1. PBS | Day 43 | 1.039 | 0.301 | 1.012 | 0.173 |
| 2. 3.0 mg/kg AC009806 | Day 43 | 0.324 | 0.082 | 0.200 | 0.040 |
| 3. 3.0 mg/kg AC007414 | Day 43 | 0.378 | 0.050 | 0.215 | 0.026 |
| | | Caudate | | Putamen | |
| Group ID | Sac Day | Rel. Exp. MAPT | Std. Dev +/− | Rel. Exp. MAPT | Std. Dev +/− |
| 1. PBS | Day 43 | 1.018 | 0.219 | 1.006 | 0.122 |
| 2. 3.0 mg/kg AC009806 | Day 43 | 0.305 | 0.066 | 0.291 | 0.053 |
| 3. 3.0 mg/kg AC007414 | Day 43 | 0.377 | 0.023 | 0.261 | 0.0544 |
| | | Hippocampus | | Cerebellum | |
| Group ID | Sac Day | Rel. Exp. MAPT | Std. Dev +/− | Rel. Exp. MAPT | Std. Dev +/− |
| 1. PBS | Day 43 | 1.002 | 0.078 | 1.006 | 0.123 |
| 2. 3.0 mg/kg AC009806 | Day 43 | 0.266 | 0.003 | 0.715 | 0.102 |
| 3. 3.0 mg/kg AC007414 | Day 43 | 0.307 | 0.036 | 0.766 | 0.079 |
| | | Thoracic Spinal Cord | | Motor Cortex | |
| Group ID | Sac Day | Rel. Exp. MAPT | Std. Dev +/− | Rel. Exp. MAPT | Std. Dev +/− |
| 1. PBS | Day 43 | 1.007 | 0.144 | 1.012 | 0.183 |
| 2. 3.0 mg/kg AC009806 | Day 43 | 0.291 | 0.050 | 0.213 | 0.028 |
| 3. 3.0 mg/kg AC007414 | Day 43 | 0.282 | 0.039 | 0.222 | 0.023 |
| | | Medulla | | Pons | |
| Group ID | Sac Day | Rel. Exp. MAPT | Std. Dev +/− | Rel. Exp. MAPT | Std. Dev +/− |
| 1. PBS | Day 43 | 1.017 | 0.215 | 1.022 | 0.240 |
| 2. 3.0 mg/kg AC009806 | Day 43 | 0.243 | 0.029 | 0.289 | 0.066 |
| 3. 3.0 mg/kg AC007414 | Day 43 | 0.287 | 0.049 | 0.261 | 0.018 |
| | | Thalamus | | Midbrain | |
| Group ID | Sac Day | Rel. Exp. MAPT | Std. Dev +/− | Rel. Exp. MAPT | Std. Dev +/− |
| 1. PBS | Day 43 | 1.002 | 0.077 | 1.006 | 0.122 |
| 2. 3.0 mg/kg AC009806 | Day 43 | 0.321 | 0.085 | 0.269 | 0.036 |
| 3. 3.0 mg/kg AC007414 | Day 43 | 0.352 | 0.035 | 0.335 | 0.097 |

MAPT RNAi agents achieved MAPT mRNA transcript knockdown out to at least Day 43 in the brain. The most notable and significant knockdown was observed in the motor cortex, with 3×3.0 mg/kg AC009806 subcutaneous (SC) dose achieving ~~79% MAPT transcript inhibition (0.213) on Day 43.

MAPT protein expression was analyzed via Jess protein assay in the cyno tissues, normalized to Group 1 cynos dosed with PBS. The MAPT protein expression data is shown in the following Table 41.

TABLE 41

MAPT protein expression in cyno tissues.

| | | Day 43 | | | |
|---|---|---|---|---|---|
| | | Frontal Cortex | | Temporal Cortex | |
| Group ID | Sac Day | Rel. Exp. MAPT | Std. Dev +/− | Rel. Exp. MAPT | Std. Dev +/− |
| 1. PBS | Day 43 | 102.062 | 23.674 | 102.260 | 25.583 |
| 2. 3.0 mg/kg AC009806 | Day 43 | 33.905 | 12.750 | 26.527 | 8.780 |
| 3. 3.0 mg/kg AC007414 | Day 43 | 33.647 | 15.521 | 31.366 | 4.909 |

| | | Caudate | | Putamen | |
|---|---|---|---|---|---|
| Group ID | Sac Day | Rel. Exp. MAPT | Std. Dev +/− | Rel. Exp. MAPT | Std. Dev +/− |
| 1. PBS | Day 43 | 100.521 | 12.221 | 102.840 | 25.380 |
| 2. 3.0 mg/kg AC009806 | Day 43 | 37.884 | 7.318 | 45.583 | 9.483 |
| 3. 3.0 mg/kg AC007414 | Day 43 | 45.084 | 2.200 | 52.174 | 5.785 |

| | | Hippocampus | |
|---|---|---|---|
| Group ID | Sac Day | Rel. Exp. MAPT | Std. Dev +/− |
| 1. PBS | Day 43 | 104.294 | 34.024 |
| 2. 3.0 mg/kg AC009806 | Day 43 | 42.938 | 14.751 |
| 3. 3.0 mg/kg AC007414 | Day 43 | 59.876 | 20.621 |

MAPT RNAi agents achieved MAPT protein knockdown out to at least Day 43 in CNS tissues. The most notable and significant knockdown was observed in the temporal cortex, with 3×3.0 mg/kg AC009806 subcutaneous (SC) dose achieving ~73% MAPT protein inhibition (26.527 relative to control) on Day 43.

Example 17. In Vivo Knockdown of MAPT in in Cynomolgus Monkeys

Cynomolgus monkeys were injected with either artificial cerebrospinal fluid (aCSF, obtained from a commercial supplier) or a compound formulation containing 1.7 mg, 5 mg, or 15 mg of a MAPT RNAi agent formulated in aCSF according to Tables 42 and 43 below:

TABLE 42

Dosing groups for the non-human primates of Example 17.

| Group ID | # Animals Dosed (n=) | Dose Concentration | Dose Volume |
|---|---|---|---|
| Group 1 aCSF | n = 4 | N/A | 2 mL |
| Group 2 1.7 mg AC004125 | n = 6 | 0.85 mg/mL | 2 mL |
| Group 3 5 mg AC004125 | n = 6 | 2.5 mg/mL | 2 mL |
| Group 4 15 mg AC004125 | n = 6 | 7.5 mg/mL | 2 mL |

Four (n=4) monkeys were dosed in group 1, six (n=6) monkeys were dosed in groups 2, 3, and 4. The test animals were cynomolgus monkeys (*Macaca fascicularis*), non-naïve, male, 3-5 years of age, and 3-5 kg in weight.

TABLE 43

Dosing groups for the non-human primates of Example 19.

| | Animals Dosed | Distribution of animals per surgical procedure (n=) | | | | | |
|---|---|---|---|---|---|---|---|
| Group ID | | Day 1 | Day 2 | Day 3 | Day 4 | Day 5 | Day 6 |
| Group 1 aCSF | n = 4 | 4 | | | | | |
| Group 2 1.7 mg AC004125 | n = 6 | | 4 | 2 | | | |
| Group 3 5 mg AC004125 | n = 6 | | | 2 | 4 | | |
| Group 4 15 mg AC004125 | n = 6 | | | | | 4 | 2 |

Monkeys were dosed on the days listed in Table 43. Table 43 details the number of animals dosed on the indicated study days for each respective test group. For example, for Group 2, four (4) cynos were dosed on Day 2, and two (2) cynos were dosed on Day 3.

Cynos were dosed via intrathecal injection. On study Day 85, animals from each group were euthanized and brain and spinal cord tissue was collected from each animal.

Intrathecal injection in NHPs is a challenging procedure and mis-dosing is commonly observed due to the limited space and accessibility leading to improper placement of the injection needle and leakage of the test article. To adjust for mis-dosing in analysis of protein and expression levels, mis-dosing criteria was defined such that improperly dosed animals were excluded.

The mis-dosing criteria were solely based on tissue distribution of RNAi agent compound. Cynomolgus monkeys were determined mis-dosed and excluded from the analysis, if approximately 50% or more of the brain tissue regions analyzed have compound concentrations lower than 25% of group mean. Out of the overall twenty-two (22) cynos which received test article, nine (9) cynos were identified as mis-dosed and both the mRNA transcript and protein expression level data were excluded from the analysis. Three (3) animals were excluded from Group 2, three (3) animals were excluded from Group 3, and three (3) animals were excluded from Group 4, for misdosing.

Average mRNA knockdown for frontal cortex, temporal cortex, hippocampus, thoracic spinal cord, cerebellum, and caudate for each group, with PPIB as endogenous control gene, relative to Group 1, are shown in Table 44 below:

TABLE 44

Relative expression of MAPT mRNA in various tissues analyzed by qPCR.

Day 85

| Group ID | Frontal Cortex Rel. Exp. MAPT | Std Dev. | Temporal Cortex Rel. Exp. MAPT | Std Dev. |
|---|---|---|---|---|
| 1. aCSF | 100.394 | 10.392 | 100.501 | 11.137 |
| 2. 1.7 mg AC004125 | 87.126 | 10.091 | 104.035 | 13.215 |
| 3. 5 mg AC004125 | 88.154 | 45.335 | 78.768 | 40.360 |
| 4. 15 mg AC004125 | 18.690 | 5.700 | 22.751 | 7.191 |

| Group ID | Hippocampus Rel. Exp. MAPT | Std Dev. | Thoracis Spinal Cord Rel. Exp. MAPT | Std Dev. |
|---|---|---|---|---|
| 1. aCSF | 101.010 | 16.577 | 140.820 | 83.359 |
| 2. 1.7 mg AC004125 | 114.587 | 57.413 | 93.333 | 24.856 |
| 3. 5 mg AC004125 | 86.453 | 15.315 | 45.933 | 9.172 |
| 4. 15 mg AC004125 | 49.400 | 38.336 | 65.097 | 61.625 |

TABLE 44-continued

Relative expression of MAPT mRNA in various tissues analyzed by qPCR.

| Group ID | Cerebellum Rel. Exp. MAPT | Std Dev. | Caudate Rel. Exp. MAPT | Std Dev. |
|---|---|---|---|---|
| 1. aCSF | 100.138 | 6.050 | 100.257 | 8.137 |
| 2. 1.7 mg AC004125 | 113.600 | 3.361 | 104.035 | 10.476 |
| 3. 5 mg AC004125 | 89.493 | 20.427 | 63.832 | 11.115 |
| 4. 15 mg AC004125 | 60.195 | 20.751 | 42.787 | 20.338 |

AC004125 achieved MAPT mRNA transcript inhibition in CNS tissues out to at least Day 85. The most notable and significant knockdown was observed in the frontal cortex, with a single 15 mg intrathecal dose achieving ~81% MAPT inhibition (18.690 relative to control) on Day 85. A dose response was observed in the frontal cortex, temporal cortex, hippocampus, cerebellum, and caudate.

Average protein knockdown for frontal cortex, temporal cortex, hippocampus, thoracic spinal cord, cerebellum, and caudate for each group, relative to Group 1, are shown in Table 45 below:

TABLE 45

Relative expression of MAPT protein in various tissues analyzed by JESS assay for each of the dosing groups of Example 17.

Day 85

| Group ID | Frontal Cortex Rel. Exp. MAPT | Std Dev. | Temporal Cortex Rel. Exp. MAPT | Std Dev. |
|---|---|---|---|---|
| 1. aCSF | 100.000 | 40.695 | 100.000 | 38.276 |
| 2. 1.7 mg AC004125 | 125.785 | 37.246 | 165.049 | 17.229 |
| 3. 5 mg AC004125 | 68.694 | 52.460 | 110.918 | 117.959 |
| 4. 15 mg AC004125 | 15.506 | 9.665 | 15.363 | 8.603 |

| Group ID | Hippocampus Rel. Exp. MAPT | Std Dev. | Thoracis Spinal Cord Rel. Exp. MAPT | Std Dev. |
|---|---|---|---|---|
| 1. aCSF | 100.000 | 50.591 | 100.000 | 61.513 |
| 2. 1.7 mg AC004125 | 88.525 | 29.149 | 84.556 | 25.898 |
| 3. 5 mg AC004125 | 41.187 | 36.452 | 42.783 | 7.833 |
| 4. 15 mg AC004125 | 12.109 | 5.609 | 54.347 | 32.419 |

| Group ID | Cerebellum Rel. Exp. MAPT | Std Dev. | Caudate Rel. Exp. MAPT | Std Dev. |
|---|---|---|---|---|
| 1. aCSF | 100.000 | 54.123 | 100.000 | 44.130 |
| 2. 1.7 mg AC004125 | 202.453 | 79.899 | 110.831 | 9.517 |
| 3. 5 mg AC004125 | 101.226 | 67.705 | 72.152 | 40.819 |
| 4. 15 mg AC004125 | 28.979 | 8.425 | 25.297 | 10.444 |

MAPT RNAi agent AC004125 achieved significant MAPT protein inhibition in CNS tissues out to at least Day 85. The most notable and significant knockdown was observed in the hippocampus, with a single 15 mg intrathecal dose achieving ~88% MAPT inhibition (12.109 relative to control) on Day 85. A dose response was observed in the frontal cortex, temporal cortex, hippocampus, cerebellum, and caudate.

Example 18. In Vivo Knockdown of MAPT in Transgenic PS19 Mice

MAPT RNAi agents were evaluated in vivo in PS19 transgenic mice. On Day 1, four (n=4) male PS19 mice were dosed, via intracerebroventricular (ICV) injection, with either 300 ug MAPT RNAi agent at 10 µl dose volume (at 30 mg/ml concentration) or with 10 µl artificial cerebrospinal fluid (aCSF, obtained from a commercial supplier). Dosing was in accordance with Table 46 below.

TABLE 46

Dosing groups mice of Example 18.

| Group ID | RNAi Agent | # Animals Dosed (n=) | Dose Concentration | Dose Volume |
| --- | --- | --- | --- | --- |
| 1 | aCSF | n = 4 | N/A | 10 µL |
| 2 | 300 ug AC005033 | n = 4 | 30 mg/mL | 10 µL |
| 3 | 300 ug AC004265 | n = 4 | 30 mg/mL | 10 µL |
| 4 | 300 ug AC912671 | n = 4 | 30 mg/mL | 10 µL |

The transgenic PS19 mice (P301S Tg mice; also known as B6; C3-Tg(Pmp-MAPT*P301S)PS19Vle/J) express the P301S mutant form of human microtubule-associated protein tau (MAPT), driven by the mouse prion protein promoter (Prnp). The expression of the mutant human MAPT hMAPT is five-fold higher than expression of the endogenous mouse MAPT mMAPT protein.

On Day 15, mice were euthanized and the left half of the brain and thoracic spinal cord were collected and stored in 10% NBF. Tissue samples were taken from the thoracic spinal cord, cortex, and cerebellum. Samples were analyzed by qPCR for MAPT mRNA knockdown, with mPPIA as endogenous control gene, normalized to Group 1 mice dosed with aCSF. Average results for each group are shown in Table 47 below.

TABLE 47

Relative expression of MAPT mRNA in various tissues analyzed by qPCR.

| | Day 15 | | | | | |
| --- | --- | --- | --- | --- | --- | --- |
| | Cortex | | | Thoracic Spinal Cord | | |
| Group ID | Rel. Exp. MAPT | Error Low | Error High | Rel. Exp. MAPT | Error Low | Error High |
| 1. aCSF | 1.000 | 0.290 | 0.408 | 1.000 | 0.251 | 0.336 |
| 2. 300 ug AC005033 | 0.134 | 0.043 | 0.062 | 0.290 | 0.033 | 0.038 |
| 3. 300 ug AC004265 | 0.802 | 0.522 | 1.498 | 0.082 | 0.026 | 0.038 |
| 4. 300 ug AC912671 | 0.140 | 0.044 | 0.064 | 0.141 | 0.036 | 0.048 |

| | Hippocampus | | |
| --- | --- | --- | --- |
| Group ID | Rel. Exp. MAPT | Error Low | Error High |
| 1. aCSF | 1.000 | 0.223 | 0.286 |
| 2. 300 ug AC005033 | 0.110 | 0.020 | 0.024 |
| 3. 300 ug AC004265 | 0.046 | 0.020 | 0.035 |
| 4. 300 ug AC912671 | 0.052 | 0.018 | 0.029 |

AC005033 achieved the greatest knockdown in the cortex, while AC004265 achieved the greatest knockdown in the thoracic spinal cord and the hippocampus.

Example 19. In Vivo Knockdown of MAPT in Transgenic PS19 Mice

MAPT RNAi agents were evaluated in vivo in PS9 transgenic mice. On Day 1, four (n=4) male and female PS19 mice were dosed, via intracerebroventricular (ICV) injection, with either 300 ug MAPT RNAi agent at 10 µl dose volume (at 30 mg/ml concentration) or with 10 µl artificial cerebrospinal fluid (aCSF, obtained from a commercial supplier). Dosing was in accordance with Table 48 below.

TABLE 48

Dosing groups mice of Example 19.

| Group ID | RNAi Agent | # Animals Dosed (n=) | Dose Concentration | Dose Volume |
| --- | --- | --- | --- | --- |
| 1 | aCSF | n = 4 | N/A | 10 µL |
| 2 | 300 ug AC005033 | n = 4 | 30 mg/mL | 10 µL |
| 3 | 300 ug AC004265 | n = 4 | 30 mg/mL | 10 µL |
| 4 | 300 ug AC912671 | n = 4 | 30 mg/mL | 10 µL |

The transgenic PS19 mice (P301S Tg mice; also known as B6; C3-Tg(Pmp-MAPT*P301S)PS19Vle/J) express the P301S mutant form of human microtubule-associated protein tau (MAPT), driven by the mouse prion protein promoter (Prnp). The expression of the mutant human MAPT hMAPT is five-fold higher than expression of the endogenous mouse MAPT mMAPT protein.

On Day 29, mice were euthanized and the left half of the brain and thoracic spinal cord were collected and stored in 10% NBF. Tissue samples were taken from the thoracic spinal cord, cortex, and cerebellum. Samples were analyzed by qPCR for MAPT mRNA knockdown, with mPPIA as endogenous control gene, normalized to Group 1 mice dosed with aCSF. Average results for each group are shown in Table 49 below.

TABLE 49

Relative expression of MAPT mRNA in various tissues analyzed by qPCR.

| | Day 29 | | | | | |
|---|---|---|---|---|---|---|
| | Cortex | | | Thoracic Spinal Cord | | |
| Group ID | Rel. Exp. MAPT | Error Low | Error High | Rel. Exp. MAPT | Error Low | Error High |
| 1. aCSF | 1.000 | 0.243 | 0.320 | 1.000 | 0.159 | 0.189 |
| 2. 300 ug AC005033 | 0.252 | 0.082 | 0.122 | 0.327 | 0.087 | 0.119 |
| 3. 300 ug AC004265 | 0.253 | 0.095 | 0.152 | 0.154 | 0.077 | 0.155 |
| 4. 300 ug AC912671 | 0.147 | 0.052 | 0.081 | 0.219 | 0.063 | 0.089 |

| | Hippocampus | | |
|---|---|---|---|
| Group ID | Rel. Exp. MAPT | Error Low | Error High |
| 1. aCSF | 1.000 | 0.638 | 1.761 |
| 2. 300 ug AC005033 | 0.284 | 0.063 | 0.081 |
| 3. 300 ug AC004265 | 0.211 | 0.047 | 0.060 |
| 4. 300 ug AC912671 | 0.219 | 0.043 | 0.054 |

AC912671 achieved the greatest knockdown in the cortex, while AC004265 achieved the greatest knockdown in the thoracic spinal cord and hippocampus.

Example 20. In Vivo Knockdown of MAPT in Transgenic PS19 Mice

MAPT RNAi agents were evaluated in vivo in PS19 transgenic mice. On Day 1, four (n=4) male and female PS19 mice were dosed, via intracerebroventricular (ICV) injection, with either 300 ug MAPT RNAi agent at 10 µl dose volume (at 30 mg/ml concentration) or with 10 µl artificial cerebrospinal fluid (aCSF, obtained from a commercial supplier). Dosing was in accordance with Table 50 below.

TABLE 50

Dosing groups mice of Example 20.

| Group ID | RNAi Agent | # Animals Dosed (n=) | Dose Concentration | Dose Volume |
|---|---|---|---|---|
| 1 | aCSF | n = 4 | N/A | 10 µL |
| 2 | 300 ug AC005033 | n = 4 | 30 mg/mL | 10 µL |
| 3 | 300 ug AC004265 | n = 4 | 30 mg/mL | 10 µL |
| 4 | 300 ug AC912671 | n = 4 | 30 mg/mL | 10 µL |

The transgenic PS19 mice (P301S Tg mice; also known as B6; C3-Tg(Pmp-MAPT*P301S)PS19Vle/J) express the P301S mutant form of human microtubule-associated protein tau (MAPT), driven by the mouse prion protein promoter (Prnp). The expression of the mutant human MAPT hMAPT is five-fold higher than expression of the endogenous mouse MAPT mMAPT protein.

On Day 85, mice were euthanized and the left half of the brain and thoracic spinal cord were collected and stored in 10% NBF. Tissue samples were taken from the thoracic spinal cord, cortex, and cerebellum. Samples were analyzed by qPCR for MAPT mRNA knockdown, with mPPIA as endogenous control gene, normalized to Group 1 mice dosed with aCSF. Average results for each group are shown in Table 51 below.

TABLE 51

Relative expression of MAPT mRNA in various tissues analyzed by qPCR.

| | Day 85 | | | | | |
|---|---|---|---|---|---|---|
| | Temporal Cortex | | | Thoracic Spinal Cord | | |
| Group ID | Rel. Exp. MAPT | Error Low | Error High | Rel. Exp. MAPT | Error Low | Error High |
| 1. aCSF | 1.000 | 0.287 | 0.402 | 1.000 | 0.128 | 0.146 |
| 2. 300 ug AC005033 | 0.863 | 0.226 | 0.306 | 0.762 | 0.211 | 0.292 |
| 3. 300 ug AC004265 | 0.618 | 0.249 | 0.417 | 0.680 | 0.201 | 0.284 |
| 4. 300 ug AC912671 | 0.499 | 0.274 | 0.606 | 0.421 | 0.190 | 0.347 |

TABLE 51-continued

Relative expression of MAPT mRNA in various tissues analyzed by qPCR.

| Group ID | Hippocampus | | |
| --- | --- | --- | --- |
| | Rel. Exp. MAPT | Error Low | Error High |
| 1. aCSF | 1.000 | 0.237 | 0.310 |
| 2. 300 ug AC005033 | 0.671 | 0.223 | 0.334 |
| 3. 300 ug AC004265 | 0.557 | 0.225 | 0.377 |
| 4. 300 ug AC912671 | 0.525 | 0.251 | 0.481 |

AC912671 achieved the greatest knockdown in all tissues analyzed.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (813 sequences)

SEQ ID NO: 1 - RNA, 5465 nt, Homo sapiens
  source 1..5465: mol_type = mRNA
gcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 2 - protein, 107 aa, synthetic construct [sequence omitted]

SEQ ID NO: 3 - protein, 214 aa, synthetic construct
DIQLTQSPSSLSASVGDRVTITCRASDKLYSNLAWYQQKPGKAPKLLIYDATLLASGVPSRFSGSGSGTDYTLTISSLQPEDFATYYCQHFWGTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 107 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 5 - protein, 223 aa, synthetic construct
EVQLVESGGGLVQPGGSLRLSCATSGFTFTSYWMHWVRQAPGKGLEWVAEINPTNGRTNYIEKFKSRITLSVDKSKSTVYLQMNSLRAEDTAVYYCARGTRAYHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 6 - protein, 11 aa, synthetic construct
RASDGLYSNLA

SEQ ID NO: 7 - protein, 11 aa, synthetic construct
RASDNLYRNLA

SEQ ID NO: 8 - protein, 11 aa, synthetic construct
RASDKLYSNLA

SEQ ID NO: 9 - protein, 7 aa, synthetic construct
DATLLAS

SEQ ID NO: 10 - protein, 7 aa, synthetic construct
DARNLAS

SEQ ID NO: 11 - protein, 7 aa, synthetic construct
DAFNLAS

SEQ ID NO: 12 - protein, 7 aa, synthetic construct
DATRLAS

SEQ ID NO: 13 - protein, 7 aa, synthetic construct
DATKLAS

SEQ ID NO: 14 - protein, 7 aa, synthetic construct
DAKNLAS

SEQ ID NO: 15 - protein, 9 aa, synthetic construct
QHFWGTPLT

SEQ ID NO: 16 - protein, 10 aa, synthetic construct
GYTFNSYWMH

SEQ ID NO: 17 - protein, 10 aa, synthetic construct
GYTFKSYWMH

SEQ ID NO: 18 - protein, 10 aa, synthetic construct
GFTFTSYWMH

SEQ ID NO: 19 - protein, 10 aa, synthetic construct
GYTFTSYWVH

SEQ ID NO: 20 - protein, 10 aa, synthetic construct
GYTFTSYWMH

SEQ ID NO: 21 - protein, 17 aa, synthetic construct
EINPTNGRVNYIEKFKS

SEQ ID NO: 22 - protein, 17 aa, synthetic construct
EINPTNGRFNYIEKFKS

SEQ ID NO: 23 - protein, 17 aa, synthetic construct
EINPTNGRTNYIEKFKS

SEQ ID NO: 24 - protein, 17 aa, synthetic construct
EINPTNGRSNYIEKFKS

SEQ ID NO: 25 - protein, 7 aa, synthetic construct
GTRAYHY

SEQ ID NO: 26 - protein, 107 aa, synthetic construct
DIQMTQSPSSLSASVGDRVTITCRASDNLYSNLAWYQQKPGKSPKLLVYDATNLADGVPSRFSGSGSGTDYTLTISSLQPEDFATYYCQHFWGTPLTFGQGTKVEIK

SEQ ID NO: 27 - protein, 107 aa, synthetic construct
DIQLTQSPSSLSASVGDRVTITCRASDGLYSNLAWYQQKPGKAPKLLIYDATKLASGVPSRFSGSGSGTDYTLTISSLQPEDFATYYCQHFWGTPLTFGQGTKVEIK

SEQ ID NO: 28 - protein, 107 aa, synthetic construct
DIQLTQSPSSLSASVGDRVTITCRASDGLYSNLAWYQQKPGKAPKLLIYDAFNLASGVPSRFSGSGSGTDYTLTISSLQPEDFATYYCQHFWGTPLTFGQGTKVEIK

SEQ ID NO: 29 - protein, 107 aa, synthetic construct
DIQLTQSPSSLSASVGDRVTITCRASDGLYSNLAWYQQKPGKAPKLLIYDATRLASGVPSRFSGSGSGTDYTLTISSLQPEDFATYYCQHFWGTPLTFGQGTKVEIK

SEQ ID NO: 30 - protein, 107 aa, synthetic construct
DIQLTQSPSSLSASVGDRVTITCRASDGLYSNLAWYQQKPGKAPKLLIYDAKNLASGVPSRFSGSGSGTDYTLTISSLQPEDFATYYCQHFWGTPLTFGQGTKVEIK

SEQ ID NO: 31 - protein, 107 aa, synthetic construct
DIQLTQSPSSLSASVGDRVTITCRASDNLYRNLAWYQQKPGKAPKLLIYDATKLASGVPSRFSGSGSGTDYTLTISSLQPEDFATYYCQHFWGTPLTFGQGTKVEIK

SEQ ID NO: 32 - protein, 107 aa, synthetic construct
DIQLTQSPSSLSASVGDRVTITCRASDKLYSNLAWYQQKPGKAPKLLIYDATLLASGVPSRFSGSGSGTDYTLTISSLQPEDFATYYCQHFWGTPLTFGQGTKVEIK

SEQ ID NO: 33 - protein, 107 aa, synthetic construct
DIQLTQSPSSLSASVGDRVTITCRASDGLYSNLAWYQQKPGKAPKLLIYDARNLASGVPSRFSGSGSGTDYTLTISSLQPEDFATYYCQHFWGTPLTFGQGTKVEIK

SEQ ID NO: 34 - protein, 107 aa, synthetic construct
DIQLTQSPSSLSASVGDRVTITCRASDNLYRNLAWYQQKPGKAPKLLIYDARNLASGVPSRFSGSGSGTDYTLTISSLQPEDFATYYCQHFWGTPLTFGQGTKVEIK

SEQ ID NO: 35 - protein, 116 aa, synthetic construct
EVQLVQSGAEVKKPGASVKVSCKASGYTFTSYWMHWVRQAPGQRLEWIGEINPTNGRTNYIEKFKSRATLTVDKSASTAYMELSSLRSEDTAVYYCARGTRAYHYWGQGTMVTVSS

SEQ ID NO: 36 - protein, 116 aa, synthetic construct
EVQLVESGGGLVQPGGSLRLSCATSGYTFTSYWVHWVRQAPGKGLEWVAEINPTNGRTNYIEKFKSRITLSVDKSKSTVYLQMNSLRAEDTAVYYCARGTRAYHYWGQGTLVTVSS

SEQ ID NO: 37 - protein, 116 aa, synthetic construct
EVQLVESGGGLVQPGGSLRLSCATSGYTFTSYWMHWVRQAPGKGLEWVAEINPTNGRVNYIEKFKSRITLSVDKSKSTVYLQMNSLRAEDTAVYYCARGTRAYHYWGQGTLVTVSS

SEQ ID NO: 38 - protein, 116 aa, synthetic construct
EVQLVESGGGLVQPGGSLRLSCATSGYTFTSYWVHWVRQAPGKGLEWVAEINPTNGRSNYIEKFKSRITLSVDKSKSTVYLQMNSLRAEDTAVYYCARGTRAYHYWGQGTLVTVSS

SEQ ID NO: 39 - protein, 116 aa, synthetic construct
EVQLVESGGGLVQPGGSLRLSCATSGYTFTSYWVHWVRQAPGKGLEWVAEINPTNGRVNYIEKFKSRITLSVDKSKSTVYLQMNSLRAEDTAVYYCARGTRAYHYWGQGTLVTVSS

SEQ ID NO: 40 - protein, 116 aa, synthetic construct
EVQLVESGGGLVQPGGSLRLSCATSGFTFTSYWMHWVRQAPGKGLEWVAEINPTNGRTNYIEKFKSRITLSVDKSKSTVYLQMNSLRAEDTAVYYCARGTRAYHYWGQGTLVTVSS

SEQ ID NO: 41 - protein, 116 aa, synthetic construct
EVQLVESGGGLVQPGGSLRLSCATSGYTFNSYWMHWVRQAPGKGLEWVAEINPTNGRTNYIEKFKSRITLSVDKSKSTVYLQMNSLRAEDTAVYYCARGTRAYHYWGQGTLVTVSS

SEQ ID NO: 42 - protein, 116 aa, synthetic construct
EVQLVESGGGLVQPGGSLRLSCATSGYTFNSYWMHWVRQAPGKGLEWVAEINPTNGRFNYIEKFKSRITLSVDKSKSTVYLQMNSLRAEDTAVYYCARGTRAYHYWGQGTLVTVSS

SEQ ID NO: 43 - protein, 116 aa, synthetic construct
EVQLVESGGGLVQPGGSLRLSCATSGYTFKSYWMHWVRQAPGKGLEWVAEINPTNGRTNYIEKFKSRITLSVDKSKSTVYLQMNSLRAEDTAVYYCARGTRAYHYWGQGTLVTVSS

SEQ ID NO: 44 - RNA, 19 nt, synthetic construct
  source 1..19: mol_type = other RNA
agatcacgctgggacgtac

SEQ ID NO: 45 - RNA, 19 nt, synthetic construct
  source 1..19: mol_type = other RNA
gatcacgctgggacgtacg

SEQ ID NO: 46 - RNA, 19 nt, synthetic construct
  source 1..19: mol_type = other RNA
aagaccaagagggtgacac

SEQ ID NO: 47 - RNA, 19 nt, synthetic construct
  source 1..19: mol_type = other RNA
agacgaagctgctggtcac

SEQ ID NO: 48 - RNA, 19 nt, synthetic construct
  source 1..19: mol_type = other RNA
gacccaagctcgcatggtc

SEQ ID NO: 49 - RNA, 19 nt, synthetic construct
  source 1..19: mol_type = other RNA
aagctcgcatggtcagtaa

SEQ ID NO: 50 - RNA, 19 nt, synthetic construct
  source 1..19: mol_type = other RNA
gctcgcatggtcagtaaaa

SEQ ID NO: 51 - RNA, 19 nt, synthetic construct
  source 1..19: mol_type = other RNA
tcgcatggtcagtaaaagc

SEQ ID NO: 52 - RNA, 19 nt, synthetic construct
  source 1..19: mol_type = other RNA
gcatggtcagtaaaagcaa

SEQ ID NO: 53 - RNA, 19 nt, synthetic construct
  source 1..19: mol_type = other RNA
catggtcagtaaaagcaaa

SEQ ID NO: 54 - RNA, 19 nt, synthetic construct
  source 1..19: mol_type = other RNA
tcagtaaaagcaaagacgg

SEQ ID NO: 55 - RNA, 19 nt, synthetic construct
  source 1..19: mol_type = other RNA
gactggaagcgatgacaaa

SEQ ID NO: 56 - RNA, 19 nt, synthetic construct
  source 1..19: mol_type = other RNA
ctggaagcgatgacaaaaa

SEQ ID NO: 57 - RNA, 19 nt, synthetic construct
  source 1..19: mol_type = other RNA
gaagcgatgacaaaaaagc

SEQ ID NO: 58 - RNA, 19 nt, synthetic construct
  source 1..19: mol_type = other RNA
caggattccagcaaaaacc

SEQ ID NO: 59 - RNA, 19 nt, synthetic construct
  source 1..19: mol_type = other RNA
aggattccagcaaaaaccc

SEQ ID NO: 60 - RNA, 19 nt, synthetic construct
  source 1..19: mol_type = other RNA
aagacaccacccagctctg

SEQ ID NO: 61 - RNA, 19 nt, synthetic construct
  source 1..19: mol_type = other RNA
tggtgaacctccaaaatca

SEQ ID NO: 62 - RNA, 19 nt, synthetic construct
  source 1..19: mol_type = other RNA
ggtgaacctccaaaatcag

SEQ ID NO: 63 - RNA, 19 nt, synthetic construct
  source 1..19: mol_type = other RNA
tgaacctccaaaatcaggg

SEQ ID NO: 64 - RNA, 19 nt, synthetic construct
  source 1..19: mol_type = other RNA
caaaatcaggggatcgcag

SEQ ID NO: 65 - RNA, 19 nt, synthetic construct
  source 1..19: mol_type = other RNA
gtgcaaatagtctacaaac

SEQ ID NO: 66 - RNA, 19 nt, synthetic construct
  source 1..19: mol_type = other RNA
aatagtctacaaaccagtt

SEQ ID NO: 67 - RNA, 19 nt, synthetic construct
  source 1..19: mol_type = other RNA
tagtctacaaaccagttga

SEQ ID NO: 68 - RNA, 19 nt, synthetic construct
  source 1..19: mol_type = other RNA
agtctacaaaccagttgac

SEQ ID NO: 69 - RNA, 19 nt, synthetic construct
  source 1..19: mol_type = other RNA
tctacaaaccagttgacct

SEQ ID NO: 70 - RNA, 19 nt, synthetic construct
  source 1..19: mol_type = other RNA
ccagttgacctgagcaagg

SEQ ID NO: 71 - RNA, 19 nt, synthetic construct
  source 1..19: mol_type = other RNA
gttgacctgagcaaggtga

SEQ ID NO: 72 - RNA, 19 nt, synthetic construct
  source 1..19: mol_type = other RNA
aaggtgacctccaagtgtg

SEQ ID NO: 73 - RNA, 19 nt, synthetic construct
  source 1..19: mol_type = other RNA
ctccaagtgtggctcatta

SEQ ID NO: 74 - RNA, 19 nt, synthetic construct
  source 1..19: mol_type = other RNA
tccaagtgtggctcattag

SEQ ID NO: 75 - RNA, 19 nt, synthetic construct
  source 1..19: mol_type = other RNA
ccaagtgtggctcattagg

SEQ ID NO: 76 - RNA, 19 nt, synthetic construct
  source 1..19: mol_type = other RNA
caagtgtggctcattaggc

SEQ ID NO: 77 - RNA, 19 nt, synthetic construct
  source 1..19: mol_type = other RNA
aagtgtggctcattaggca

SEQ ID NO: 78 - RNA, 19 nt, synthetic construct
  source 1..19: mol_type = other RNA
ggctcattaggcaacatcc

SEQ ID NO: 79 - RNA, 19 nt, synthetic construct
  source 1..19: mol_type = other RNA
taggcaacatccatcataa

SEQ ID NO: 80 - RNA, 19 nt, synthetic construct
  source 1..19: mol_type = other RNA
aggcaacatccatcataaa

SEQ ID NO: 81 - RNA, 19 nt, synthetic construct
  source 1..19: mol_type = other RNA
gcaacatccatcataaacc

SEQ ID NO: 82 - RNA, 19 nt, synthetic construct
  source 1..19: mol_type = other RNA
gtggccaggtggaagtaaa

SEQ ID NO: 83 - RNA, 19 nt, synthetic construct
  source 1..19: mol_type = other RNA
ccaggtggaagtaaaatct

SEQ ID NO: 84 - RNA, 19 nt, synthetic construct
  source 1..19: mol_type = other RNA
caggtggaagtaaaatctg

SEQ ID NO: 85 - RNA, 19 nt, synthetic construct
  source 1..19: mol_type = other RNA
ggtccctggacaatatcac

SEQ ID NO: 86 - RNA, 19 nt, synthetic construct
  source 1..19: mol_type = other RNA
tccctggacaatatcaccc

SEQ ID NO: 87 - RNA, 19 nt, synthetic construct
  source 1..19: mol_type = other RNA
agattgaaacccacaagct

SEQ ID NO: 88 - RNA, 19 nt, synthetic construct
  source 1..19: mol_type = other RNA
attgaaacccacaagctga

SEQ ID NO: 89 - RNA, 19 nt, synthetic construct
  source 1..19: mol_type = other RNA
ttgaaacccacaagctgac

SEQ ID NO: 90 - DNA, 19 bp, synthetic construct
  source 1..19: mol_type = other DNA
gccaaagccaagacagacc

SEQ ID NO: 91 - RNA, 19 nt, synthetic construct
  source 1..19: mol_type = other RNA
cagcatcgacatggtagac

SEQ ID NO: 92 - RNA, 19 nt, synthetic construct
  source 1..19: mol_type = other RNA
gcatcgacatggtagactc

SEQ ID NO: 93 - RNA, 19 nt, synthetic construct
  source 1..19: mol_type = other RNA
ttacgtcccagcgtgatct

SEQ ID NO: 94 - RNA, 19 nt, synthetic construct
  source 1..19: mol_type = other RNA
atacgtcccagcgtgatct

SEQ ID NO: 95 - RNA, 19 nt, synthetic construct
  source 1..19: mol_type = other RNA
gtacgtcccagcgtgatct

SEQ ID NO: 96 - RNA, 19 nt, synthetic construct
  source 1..19: mol_type = other RNA
ntacgtcccagcgtgatct

SEQ ID NO: 97 - RNA, 19 nt, synthetic construct
  source 1..19: mol_type = other RNA
ntacgtcccagcgtgatcn

SEQ ID NO: 98 - RNA, 19 nt, synthetic construct
  source 1..19: mol_type = other RNA
tgtacgtcccagcgtgatc

SEQ ID NO: 99 - RNA, 19 nt, synthetic construct
  source 1..19: mol_type = other RNA
agtacgtcccagcgtgatc

SEQ ID NO: 100 - RNA, 19 nt, synthetic construct
  source 1..19: mol_type = other RNA
cgtacgtcccagcgtgatc

SEQ ID NO: 101 - RNA, 19 nt, synthetic construct
  source 1..19: mol_type = other RNA
ngtacgtcccagcgtgatc

SEQ ID NO: 102 - RNA, 19 nt, synthetic construct
  source 1..19: mol_type = other RNA
ngtacgtcccagcgtgatn

SEQ ID NO: 103 - RNA, 19 nt, synthetic construct
  source 1..19: mol_type = other RNA
ttgtcaccctcttggtctt

SEQ ID NO: 104 - RNA, 19 nt, synthetic construct
  source 1..19: mol_type = other RNA
atgtcaccctcttggtctt

SEQ ID NO: 105 - RNA, 19 nt, synthetic construct
  source 1..19: mol_type = other RNA
gtgtcaccctcttggtctt

SEQ ID NO: 106 - RNA, 19 nt, synthetic construct
  source 1..19: mol_type = other RNA
ntgtcaccctcttggtctt

SEQ ID NO: 107 - RNA, 19 nt, synthetic construct
  source 1..19: mol_type = other RNA
ntgtcaccctcttggtctn

SEQ ID NO: 108 - RNA, 19 nt, synthetic construct
  source 1..19: mol_type = other RNA
ttgaccagcagcttcgtct

SEQ ID NO: 109 - RNA, 19 nt, synthetic construct
  source 1..19: mol_type = other RNA
atgaccagcagcttcgtct

SEQ ID NO: 110 - RNA, 19 nt, synthetic construct
  source 1..19: mol_type = other RNA
gtgaccagcagcttcgtct

SEQ ID NO: 111 - RNA, 19 nt, synthetic construct
  source 1..19: mol_type = other RNA
ntgaccagcagcttcgtct

SEQ ID NO: 112 - RNA, 19 nt, synthetic construct
  source 1..19: mol_type = other RNA
ntgaccagcagcttcgtcn

SEQ ID NO: 113 - RNA, 19 nt, synthetic construct
  source 1..19: mol_type = other RNA
taccatgcgagcttgggtc

SEQ ID NO: 114 - RNA, 19 nt, synthetic construct
  source 1..19: mol_type = other RNA
aaccatgcgagcttgggtc

SEQ ID NO: 115 - RNA, 19 nt, synthetic construct
  source 1..19: mol_type = other RNA
gaccatgcgagcttgggtc

SEQ ID NO: 116 - RNA, 19 nt, synthetic construct
  source 1..19: mol_type = other RNA
naccatgcgagcttgggtc

SEQ ID NO: 117 - RNA, 19 nt, synthetic construct
  source 1..19: mol_type = other RNA
naccatgcgagcttgggtn

SEQ ID NO: 118 - RNA, 19 nt, synthetic construct
  source 1..19: mol_type = other RNA
atactgaccatgcgagctt

SEQ ID NO: 119 - RNA, 19 nt, synthetic construct
  source 1..19: mol_type = other RNA
ttactgaccatgcgagctt

SEQ ID NO: 120 - RNA, 19 nt, synthetic construct
  source 1..19: mol_type = other RNA
ntactgaccatgcgagctt

SEQ ID NO: 121 - RNA, 19 nt, synthetic construct
  source 1..19: mol_type = other RNA
ntactgaccatgcgagctn

SEQ ID NO: 122 - RNA, 19 nt, synthetic construct
  source 1..19: mol_type = other RNA
atttactgaccatgcgagc

SEQ ID NO: 123 - RNA, 19 nt, synthetic construct
  source 1..19: mol_type = other RNA
ttttactgaccatgcgagc

SEQ ID NO: 124 - RNA, 19 nt, synthetic construct
  source 1..19: mol_type = other RNA
ntttactgaccatgcgagc

SEQ ID NO: 125 - RNA, 19 nt, synthetic construct
  source 1..19: mol_type = other RNA
ntttactgaccatgcgagn

SEQ ID NO: 126 - RNA, 19 nt, synthetic construct
  source 1..19: mol_type = other RNA
tcttttactgaccatgcga

SEQ ID NO: 127 - RNA, 19 nt, synthetic construct
  source 1..19: mol_type = other RNA
acttttactgaccatgcga

SEQ ID NO: 128 - RNA, 19 nt, synthetic construct
  source 1..19: mol_type = other RNA
gcttttactgaccatgcga

SEQ ID NO: 129 - RNA, 19 nt, synthetic construct
  source 1..19: mol_type = other RNA
ncttttactgaccatgcga

SEQ ID NO: 130 - RNA, 19 nt, synthetic construct
  source 1..19: mol_type = other RNA
ncttttactgaccatgcgn

SEQ ID NO: 131 - RNA, 19 nt, synthetic construct
  source 1..19: mol_type = other RNA
atgcttttactgaccatgc

SEQ ID NO: 132 - RNA, 19 nt, synthetic construct
  source 1..19: mol_type = other RNA
ttgcttttactgaccatgc

SEQ ID NO: 133 - RNA, 19 nt, synthetic construct
  source 1..19: mol_type = other RNA
ntgcttttactgaccatgc

SEQ ID NO: 134 - RNA, 19 nt, synthetic construct
  source 1..19: mol_type = other RNA
ntgcttttactgaccatgn

SEQ ID NO: 135 - RNA, 19 nt, synthetic construct
  source 1..19: mol_type = other RNA
attgcttttactgaccatg

SEQ ID NO: 136 - RNA, 19 nt, synthetic construct
  source 1..19: mol_type = other RNA
tttgcttttactgaccatg

SEQ ID NO: 137 - RNA, 19 nt, synthetic construct
  source 1..19: mol_type = other RNA
nttgcttttactgaccatg

SEQ ID NO: 138 - RNA, 19 nt, synthetic construct
  source 1..19: mol_type = other RNA
nttgcttttactgaccatn

SEQ ID NO: 139 - RNA, 19 nt, synthetic construct
  source 1..19: mol_type = other RNA
tcgtctttgcttttactga

SEQ ID NO: 140 - RNA, 19 nt, synthetic construct
  source 1..19: mol_type = other RNA
acgtctttgcttttactga

SEQ ID NO: 141 - RNA, 19 nt, synthetic construct
  source 1..19: mol_type = other RNA
ccgtctttgcttttactga

SEQ ID NO: 142 - RNA, 19 nt, synthetic construct
  source 1..19: mol_type = other RNA
ncgtctttgcttttactga

SEQ ID NO: 143 - RNA, 19 nt, synthetic construct
  source 1..19: mol_type = other RNA
ncgtctttgcttttactgn

SEQ ID NO: 144 - RNA, 19 nt, synthetic construct
  source 1..19: mol_type = other RNA
attgtcatcgcttccagtc

SEQ ID NO: 145 - RNA, 19 nt, synthetic construct
  source 1..19: mol_type = other RNA
tttgtcatcgcttccagtc

SEQ ID NO: 146 - RNA, 19 nt, synthetic construct
  source 1..19: mol_type = other RNA
nttgtcatcgcttccagtc

SEQ ID NO: 147 - RNA, 19 nt, synthetic construct
  source 1..19: mol_type = other RNA
nttgtcatcgcttccagtn

SEQ ID NO: 148 - RNA, 19 nt, synthetic construct
  source 1..19: mol_type = other RNA
attttgtcatcgcttccag

SEQ ID NO: 149 - RNA, 19 nt, synthetic construct
  source 1..19: mol_type = other RNA
tttttgtcatcgcttccag

SEQ ID NO: 150 - RNA, 19 nt, synthetic construct
  source 1..19: mol_type = other RNA
nttttgtcatcgcttccag

SEQ ID NO: 151 - RNA, 19 nt, synthetic construct
  source 1..19: mol_type = other RNA
nttttgtcatcgcttccan

SEQ ID NO: 152 - RNA, 19 nt, synthetic construct
  source 1..19: mol_type = other RNA
tcttttttgtcatcgcttc

SEQ ID NO: 153 - RNA, 19 nt, synthetic construct
  source 1..19: mol_type = other RNA
acttttttgtcatcgcttc

SEQ ID NO: 154 - RNA, 19 nt, synthetic construct
  source 1..19: mol_type = other RNA
gcttttttgtcatcgcttc

SEQ ID NO: 155 - RNA, 19 nt, synthetic construct
  source 1..19: mol_type = other RNA
ncttttttgtcatcgcttc

SEQ ID NO: 156 - RNA, 19 nt, synthetic construct
  source 1..19: mol_type = other RNA
ncttttttgtcatcgcttn

SEQ ID NO: 157 - RNA, 19 nt, synthetic construct
  source 1..19: mol_type = other RNA
tgtttttgctggaatcctg

SEQ ID NO: 158 - RNA, 19 nt, synthetic construct
  source 1..19: mol_type = other RNA
agtttttgctggaatcctg

SEQ ID NO: 159 - RNA, 19 nt, synthetic construct
  source 1..19: mol_type = other RNA
ggtttttgctggaatcctg

SEQ ID NO: 160 - RNA, 19 nt, synthetic construct
  source 1..19: mol_type = other RNA
ngtttttgctggaatcctg

SEQ ID NO: 161 - RNA, 19 nt, synthetic construct
  source 1..19: mol_type = other RNA
ngtttttgctggaatcctn

SEQ ID NO: 162 - RNA, 19 nt, synthetic construct
  source 1..19: mol_type = other RNA
tggtttttgctggaatcct

SEQ ID NO: 163 - RNA, 19 nt, synthetic construct
  source 1..19: mol_type = other RNA
aggtttttgctggaatcct

SEQ ID NO: 164 - RNA, 19 nt, synthetic construct
  source 1..19: mol_type = other RNA
gggtttttgctggaatcct

SEQ ID NO: 165 - RNA, 19 nt, synthetic construct
  source 1..19: mol_type = other RNA
nggtttttgctggaatcct

SEQ ID NO: 166 - RNA, 19 nt, synthetic construct
  source 1..19: mol_type = other RNA
nggtttttgctggaatccn

SEQ ID NO: 167 - RNA, 19 nt, synthetic construct
  source 1..19: mol_type = other RNA
tagagctgggtggtgtctt

SEQ ID NO: 168 - RNA, 19 nt, synthetic construct
  source 1..19: mol_type = other RNA
aagagctgggtggtgtctt

SEQ ID NO: 169 - RNA, 19 nt, synthetic construct
  source 1..19: mol_type = other RNA
cagagctgggtggtgtctt

SEQ ID NO: 170 - RNA, 19 nt, synthetic construct
  source 1..19: mol_type = other RNA
nagagctgggtggtgtctt

SEQ ID NO: 171 - RNA, 19 nt, synthetic construct
  source 1..19: mol_type = other RNA
nagagctgggtggtgtctn

SEQ ID NO: 172 - RNA, 19 nt, synthetic construct
  source 1..19: mol_type = other RNA
agattttggaggttcacca

SEQ ID NO: 173 - RNA, 19 nt, synthetic construct
  source 1..19: mol_type = other RNA
tgattttggaggttcacca

SEQ ID NO: 174 - RNA, 19 nt, synthetic construct
  source 1..19: mol_type = other RNA
ngattttggaggttcacca

SEQ ID NO: 175 - RNA, 19 nt, synthetic construct
  source 1..19: mol_type = other RNA
ngattttggaggttcaccn

SEQ ID NO: 176 - RNA, 19 nt, synthetic construct
  source 1..19: mol_type = other RNA
ttgattttggaggttcacc

SEQ ID NO: 177 - RNA, 19 nt, synthetic construct
  source 1..19: mol_type = other RNA
atgattttggaggttcacc

SEQ ID NO: 178 - RNA, 19 nt, synthetic construct
  source 1..19: mol_type = other RNA
ctgattttggaggttcacc

SEQ ID NO: 179 - RNA, 19 nt, synthetic construct
  source 1..19: mol_type = other RNA
ntgattttggaggttcacc

SEQ ID NO: 180 - RNA, 19 nt, synthetic construct
  source 1..19: mol_type = other RNA
ntgattttggaggttcacn

SEQ ID NO: 181 - RNA, 19 nt, synthetic construct
  source 1..19: mol_type = other RNA
tcctgattttggaggttca

SEQ ID NO: 182 - RNA, 19 nt, synthetic construct
  source 1..19: mol_type = other RNA
acctgattttggaggttca

SEQ ID NO: 183 - RNA, 19 nt, synthetic construct
  source 1..19: mol_type = other RNA
ccctgattttggaggttca

SEQ ID NO: 184 - RNA, 19 nt, synthetic construct
  source 1..19: mol_type = other RNA
ncctgattttggaggttca

SEQ ID NO: 185 - RNA, 19 nt, synthetic construct
  source 1..19: mol_type = other RNA
ncctgattttggaggttcn

SEQ ID NO: 186 - RNA, 19 nt, synthetic construct
  source 1..19: mol_type = other RNA
ttgcgatcccctgattttg

SEQ ID NO: 187 - RNA, 19 nt, synthetic construct
  source 1..19: mol_type = other RNA
atgcgatcccctgattttg

SEQ ID NO: 188 - RNA, 19 nt, synthetic construct
  source 1..19: mol_type = other RNA
ctgcgatcccctgattttg

SEQ ID NO: 189 - RNA, 19 nt, synthetic construct
  source 1..19: mol_type = other RNA
ntgcgatcccctgattttg

SEQ ID NO: 190 - RNA, 19 nt, synthetic construct
  source 1..19: mol_type = other RNA
ntgcgatcccctgattttn

SEQ ID NO: 191 - RNA, 19 nt, synthetic construct
  source 1..19: mol_type = other RNA
ttttgtagactatttgcac

SEQ ID NO: 192 - RNA, 19 nt, synthetic construct
  source 1..19: mol_type = other RNA
atttgtagactatttgcac

SEQ ID NO: 193 - RNA, 19 nt, synthetic construct
  source 1..19: mol_type = other RNA
gtttgtagactatttgcac

SEQ ID NO: 194 - RNA, 19 nt, synthetic construct
  source 1..19: mol_type = other RNA
ntttgtagactatttgcac

SEQ ID NO: 195 - RNA, 19 nt, synthetic construct
  source 1..19: mol_type = other RNA
ntttgtagactatttgcan

SEQ ID NO: 196 - RNA, 19 nt, synthetic construct
  source 1..19: mol_type = other RNA
tactggtttgtagactatt

SEQ ID NO: 197 - RNA, 19 nt, synthetic construct
  source 1..19: mol_type = other RNA
aactggtttgtagactatt

SEQ ID NO: 198 - RNA, 19 nt, synthetic construct
  source 1..19: mol_type = other RNA
nactggtttgtagactatt

SEQ ID NO: 199 - RNA, 19 nt, synthetic construct
  source 1..19: mol_type = other RNA
nactggtttgtagactatn

SEQ ID NO: 200 - RNA, 19 nt, synthetic construct
  source 1..19: mol_type = other RNA
acaactggtttgtagacta

SEQ ID NO: 201 - RNA, 19 nt, synthetic construct
  source 1..19: mol_type = other RNA
tcaactggtttgtagacta

SEQ ID NO: 202 - RNA, 19 nt, synthetic construct
  source 1..19: mol_type = other RNA
ncaactggtttgtagacta

SEQ ID NO: 203 - RNA, 19 nt, synthetic construct
  source 1..19: mol_type = other RNA
ncaactggtttgtagactn

SEQ ID NO: 204 - RNA, 19 nt, synthetic construct
  source 1..19: mol_type = other RNA
ttcaactggtttgtagact

SEQ ID NO: 205 - RNA, 19 nt, synthetic construct
  source 1..19: mol_type = other RNA
atcaactggtttgtagact

SEQ ID NO: 206 - RNA, 19 nt, synthetic construct
  source 1..19: mol_type = other RNA
gtcaactggtttgtagact

SEQ ID NO: 207 - RNA, 19 nt, synthetic construct
  source 1..19: mol_type = other RNA
ntcaactggtttgtagact

SEQ ID NO: 208 - RNA, 19 nt, synthetic construct
  source 1..19: mol_type = other RNA
ntcaactggtttgtagacn

SEQ ID NO: 209 - RNA, 19 nt, synthetic construct
  source 1..19: mol_type = other RNA
tggtcaactggtttgtaga

SEQ ID NO: 210 - RNA, 19 nt, synthetic construct
  source 1..19: mol_type = other RNA
aggtcaactggtttgtaga

SEQ ID NO: 211 - RNA, 19 nt, synthetic construct
  source 1..19: mol_type = other RNA
nggtcaactggtttgtaga

SEQ ID NO: 212 - RNA, 19 nt, synthetic construct
  source 1..19: mol_type = other RNA
nggtcaactggtttgtagn

SEQ ID NO: 213 - RNA, 19 nt, synthetic construct
  source 1..19: mol_type = other RNA
tcttgctcaggtcaactgg

SEQ ID NO: 214 - RNA, 19 nt, synthetic construct
  source 1..19: mol_type = other RNA
acttgctcaggtcaactgg

SEQ ID NO: 215 - RNA, 19 nt, synthetic construct
  source 1..19: mol_type = other RNA
ccttgctcaggtcaactgg

SEQ ID NO: 216 - RNA, 19 nt, synthetic construct
  source 1..19: mol_type = other RNA
ncttgctcaggtcaactgg

SEQ ID NO: 217 - RNA, 19 nt, synthetic construct
  source 1..19: mol_type = other RNA
ncttgctcaggtcaactgn

SEQ ID NO: 218 - RNA, 19 nt, synthetic construct
  source 1..19: mol_type = other RNA
acaccttgctcaggtcaac

SEQ ID NO: 219 - RNA, 19 nt, synthetic construct
  source 1..19: mol_type = other RNA
tcaccttgctcaggtcaac

SEQ ID NO: 220 - RNA, 19 nt, synthetic construct
  source 1..19: mol_type = other RNA
ncaccttgctcaggtcaac

SEQ ID NO: 221 - RNA, 19 nt, synthetic construct
  source 1..19: mol_type = other RNA
ncaccttgctcaggtcaan

SEQ ID NO: 222 - RNA, 19 nt, synthetic construct
  source 1..19: mol_type = other RNA
tacacttggaggtcacctt

SEQ ID NO: 223 - RNA, 19 nt, synthetic construct
  source 1..19: mol_type = other RNA
aacacttggaggtcacctt

SEQ ID NO: 224 - RNA, 19 nt, synthetic construct
  source 1..19: mol_type = other RNA
cacacttggaggtcacctt

SEQ ID NO: 225 - RNA, 19 nt, synthetic construct
  source 1..19: mol_type = other RNA
nacacttggaggtcacctt

SEQ ID NO: 226 - RNA, 19 nt, synthetic construct
  source 1..19: mol_type = other RNA
nacacttggaggtcacctn

SEQ ID NO: 227 - RNA, 19 nt, synthetic construct
  source 1..19: mol_type = other RNA
aaatgagccacacttggag

SEQ ID NO: 228 - RNA, 19 nt, synthetic construct
  source 1..19: mol_type = other RNA
taatgagccacacttggag

SEQ ID NO: 229 - RNA, 19 nt, synthetic construct
  source 1..19: mol_type = other RNA
naatgagccacacttggag

SEQ ID NO: 230 - RNA, 19 nt, synthetic construct
  source 1..19: mol_type = other RNA
naatgagccacacttggan

SEQ ID NO: 231 - RNA, 19 nt, synthetic construct
  source 1..19: mol_type = other RNA
ttaatgagccacacttgga

SEQ ID NO: 232 - RNA, 19 nt, synthetic construct
  source 1..19: mol_type = other RNA
ataatgagccacacttgga

SEQ ID NO: 233 - RNA, 19 nt, synthetic construct
  source 1..19: mol_type = other RNA
ctaatgagccacacttgga

SEQ ID NO: 234 - RNA, 19 nt, synthetic construct
  source 1..19: mol_type = other RNA
ntaatgagccacacttgga

SEQ ID NO: 235 - RNA, 19 nt, synthetic construct
  source 1..19: mol_type = other RNA
ntaatgagccacacttggn

SEQ ID NO: 236 - RNA, 19 nt, synthetic construct
  source 1..19: mol_type = other RNA
tctaatgagccacacttgg

SEQ ID NO: 237 - RNA, 19 nt, synthetic construct
  source 1..19: mol_type = other RNA
actaatgagccacacttgg

SEQ ID NO: 238 - RNA, 19 nt, synthetic construct
  source 1..19: mol_type = other RNA
cctaatgagccacacttgg

SEQ ID NO: 239 - RNA, 19 nt, synthetic construct
  source 1..19: mol_type = other RNA
nctaatgagccacacttgg

SEQ ID NO: 240 - RNA, 19 nt, synthetic construct
  source 1..19: mol_type = other RNA
nctaatgagccacacttgn

SEQ ID NO: 241 - RNA, 19 nt, synthetic construct
  source 1..19: mol_type = other RNA
tcctaatgagccacacttg

SEQ ID NO: 242 - RNA, 19 nt, synthetic construct
  source 1..19: mol_type = other RNA
acctaatgagccacacttg

SEQ ID NO: 243 - RNA, 19 nt, synthetic construct
  source 1..19: mol_type = other RNA
gcctaatgagccacacttg

SEQ ID NO: 244 - RNA, 19 nt, synthetic construct
  source 1..19: mol_type = other RNA
ncctaatgagccacacttg

SEQ ID NO: 245 - RNA, 19 nt, synthetic construct
  source 1..19: mol_type = other RNA
ncctaatgagccacacttn

SEQ ID NO: 246 - RNA, 19 nt, synthetic construct
  source 1..19: mol_type = other RNA
agcctaatgagccacactt

SEQ ID NO: 247 - RNA, 19 nt, synthetic construct
  source 1..19: mol_type = other RNA
tgcctaatgagccacactt

SEQ ID NO: 248 - RNA, 19 nt, synthetic construct
  source 1..19: mol_type = other RNA
ngcctaatgagccacactt

SEQ ID NO: 249 - RNA, 19 nt, synthetic construct
  source 1..19: mol_type = other RNA
ngcctaatgagccacactn

SEQ ID NO: 250 - RNA, 19 nt, synthetic construct
  source 1..19: mol_type = other RNA
tgatgttgcctaatgagcc

SEQ ID NO: 251 - RNA, 19 nt, synthetic construct
  source 1..19: mol_type = other RNA
agatgttgcctaatgagcc

SEQ ID NO: 252 - RNA, 19 nt, synthetic construct
  source 1..19: mol_type = other RNA
ggatgttgcctaatgagcc

SEQ ID NO: 253 - RNA, 19 nt, synthetic construct
  source 1..19: mol_type = other RNA
ngatgttgcctaatgagcc

SEQ ID NO: 254 - RNA, 19 nt, synthetic construct
  source 1..19: mol_type = other RNA
ngatgttgcctaatgagcn

SEQ ID NO: 255 - RNA, 19 nt, synthetic construct
  source 1..19: mol_type = other RNA
atatgatggatgttgccta

SEQ ID NO: 256 - RNA, 19 nt, synthetic construct
  source 1..19: mol_type = other RNA
ttatgatggatgttgccta

SEQ ID NO: 257 - RNA, 19 nt, synthetic construct
  source 1..19: mol_type = other RNA
ntatgatggatgttgccta

SEQ ID NO: 258 - RNA, 19 nt, synthetic construct
  source 1..19: mol_type = other RNA
ntatgatggatgttgcctn

SEQ ID NO: 259 - RNA, 19 nt, synthetic construct
  source 1..19: mol_type = other RNA
attatgatggatgttgcct

SEQ ID NO: 260 - RNA, 19 nt, synthetic construct
  source 1..19: mol_type = other RNA
tttatgatggatgttgcct

SEQ ID NO: 261 - RNA, 19 nt, synthetic construct
  source 1..19: mol_type = other RNA
nttatgatggatgttgcct

SEQ ID NO: 262 - RNA, 19 nt, synthetic construct
  source 1..19: mol_type = other RNA
nttatgatggatgttgccn

SEQ ID NO: 263 - RNA, 19 nt, synthetic construct
  source 1..19: mol_type = other RNA
tgtttatgatggatgttgc

SEQ ID NO: 264 - RNA, 19 nt, synthetic construct
  source 1..19: mol_type = other RNA
agtttatgatggatgttgc

SEQ ID NO: 265 - RNA, 19 nt, synthetic construct
  source 1..19: mol_type = other RNA
ggtttatgatggatgttgc

SEQ ID NO: 266 - RNA, 19 nt, synthetic construct
  source 1..19: mol_type = other RNA
ngtttatgatggatgttgc

SEQ ID NO: 267 - RNA, 19 nt, synthetic construct
  source 1..19: mol_type = other RNA
ngtttatgatggatgttgn

SEQ ID NO: 268 - RNA, 19 nt, synthetic construct
  source 1..19: mol_type = other RNA
attacttccacctggccac

SEQ ID NO: 269 - RNA, 19 nt, synthetic construct
  source 1..19: mol_type = other RNA
tttacttccacctggccac

SEQ ID NO: 270 - RNA, 19 nt, synthetic construct
  source 1..19: mol_type = other RNA
nttacttccacctggccac

SEQ ID NO: 271 - RNA, 19 nt, synthetic construct
  source 1..19: mol_type = other RNA
nttacttccacctggccan

SEQ ID NO: 272 - RNA, 19 nt, synthetic construct
  source 1..19: mol_type = other RNA
tgattttacttccacctgg

SEQ ID NO: 273 - RNA, 19 nt, synthetic construct
  source 1..19: mol_type = other RNA
agattttacttccacctgg

SEQ ID NO: 274 - RNA, 19 nt, synthetic construct
  source 1..19: mol_type = other RNA
ngattttacttccacctgg

SEQ ID NO: 275 - RNA, 19 nt, synthetic construct
  source 1..19: mol_type = other RNA
ngattttacttccacctgn

SEQ ID NO: 276 - RNA, 19 nt, synthetic construct
  source 1..19: mol_type = other RNA
tagattttacttccacctg

SEQ ID NO: 277 - RNA, 19 nt, synthetic construct
  source 1..19: mol_type = other RNA
aagattttacttccacctg

SEQ ID NO: 278 - RNA, 19 nt, synthetic construct
  source 1..19: mol_type = other RNA
cagattttacttccacctg

SEQ ID NO: 279 - RNA, 19 nt, synthetic construct
  source 1..19: mol_type = other RNA
nagattttacttccacctg

SEQ ID NO: 280 - RNA, 19 nt, synthetic construct
  source 1..19: mol_type = other RNA
nagattttacttccacctn

SEQ ID NO: 281 - RNA, 19 nt, synthetic construct
  source 1..19: mol_type = other RNA
ttgatattgtccagggacc

SEQ ID NO: 282 - RNA, 19 nt, synthetic construct
  source 1..19: mol_type = other RNA
atgatattgtccagggacc

SEQ ID NO: 283 - RNA, 19 nt, synthetic construct
  source 1..19: mol_type = other RNA
gtgatattgtccagggacc

SEQ ID NO: 284 - RNA, 19 nt, synthetic construct
  source 1..19: mol_type = other RNA
ntgatattgtccagggacc

SEQ ID NO: 285 - RNA, 19 nt, synthetic construct
  source 1..19: mol_type = other RNA
ntgatattgtccagggacn

SEQ ID NO: 286 - RNA, 19 nt, synthetic construct
  source 1..19: mol_type = other RNA
tggtgatattgtccaggga

SEQ ID NO: 287 - RNA, 19 nt, synthetic construct
  source 1..19: mol_type = other RNA
aggtgatattgtccaggga

SEQ ID NO: 288 - RNA, 19 nt, synthetic construct
  source 1..19: mol_type = other RNA
gggtgatattgtccaggga

SEQ ID NO: 289 - RNA, 19 nt, synthetic construct
  source 1..19: mol_type = other RNA
nggtgatattgtccaggga

SEQ ID NO: 290 - RNA, 19 nt, synthetic construct
  source 1..19: mol_type = other RNA
nggtgatattgtccagggn

SEQ ID NO: 291 - RNA, 19 nt, synthetic construct
  source 1..19: mol_type = other RNA
tgcttgtgggtttcaatct

SEQ ID NO: 292 - RNA, 19 nt, synthetic construct
  source 1..19: mol_type = other RNA
agcttgtgggtttcaatct

SEQ ID NO: 293 - RNA, 19 nt, synthetic construct
  source 1..19: mol_type = other RNA
ngcttgtgggtttcaatct

SEQ ID NO: 294 - RNA, 19 nt, synthetic construct
  source 1..19: mol_type = other RNA
ngcttgtgggtttcaatcn

SEQ ID NO: 295 - RNA, 19 nt, synthetic construct
  source 1..19: mol_type = other RNA
acagcttgtgggtttcaat

SEQ ID NO: 296 - RNA, 19 nt, synthetic construct
  source 1..19: mol_type = other RNA
tcagcttgtgggtttcaat

SEQ ID NO: 297 - RNA, 19 nt, synthetic construct
  source 1..19: mol_type = other RNA
ncagcttgtgggtttcaat

SEQ ID NO: 298 - RNA, 19 nt, synthetic construct
  source 1..19: mol_type = other RNA
ncagcttgtgggtttcaan

SEQ ID NO: 299 - RNA, 19 nt, synthetic construct
  source 1..19: mol_type = other RNA
ttcagcttgtgggtttcaa

SEQ ID NO: 300 - RNA, 19 nt, synthetic construct
  source 1..19: mol_type = other RNA
atcagcttgtgggtttcaa

SEQ ID NO: 301 - RNA, 19 nt, synthetic construct
  source 1..19: mol_type = other RNA
gtcagcttgtgggtttcaa

SEQ ID NO: 302 - RNA, 19 nt, synthetic construct
  source 1..19: mol_type = other RNA
ntcagcttgtgggtttcaa

SEQ ID NO: 303 - RNA, 19 nt, synthetic construct
  source 1..19: mol_type = other RNA
ntcagcttgtgggtttcan

SEQ ID NO: 304 - RNA, 19 nt, synthetic construct
  source 1..19: mol_type = other RNA
tgtctgtcttggctttggc

SEQ ID NO: 305 - RNA, 19 nt, synthetic construct
  source 1..19: mol_type = other RNA
agtctgtcttggctttggc

SEQ ID NO: 306 - RNA, 19 nt, synthetic construct
  source 1..19: mol_type = other RNA
ggtctgtcttggctttggc

SEQ ID NO: 307 - RNA, 19 nt, synthetic construct
  source 1..19: mol_type = other RNA
ngtctgtcttggctttggc

SEQ ID NO: 308 - RNA, 19 nt, synthetic construct
  source 1..19: mol_type = other RNA
ngtctgtcttggctttggn

SEQ ID NO: 309 - RNA, 19 nt, synthetic construct
  source 1..19: mol_type = other RNA
ttctaccatgtcgatgctg

SEQ ID NO: 310 - RNA, 19 nt, synthetic construct
  source 1..19: mol_type = other RNA
atctaccatgtcgatgctg

SEQ ID NO: 311 - RNA, 19 nt, synthetic construct
  source 1..19: mol_type = other RNA
gtctaccatgtcgatgctg

SEQ ID NO: 312 - RNA, 19 nt, synthetic construct
  source 1..19: mol_type = other RNA
ntctaccatgtcgatgctg

SEQ ID NO: 313 - RNA, 19 nt, synthetic construct
  source 1..19: mol_type = other RNA
ntctaccatgtcgatgctn

SEQ ID NO: 314 - RNA, 19 nt, synthetic construct
  source 1..19: mol_type = other RNA
tagtctaccatgtcgatgc

SEQ ID NO: 315 - RNA, 19 nt, synthetic construct
  source 1..19: mol_type = other RNA
aagtctaccatgtcgatgc

SEQ ID NO: 316 - RNA, 19 nt, synthetic construct
  source 1..19: mol_type = other RNA
gagtctaccatgtcgatgc

SEQ ID NO: 317 - RNA, 19 nt, synthetic construct
  source 1..19: mol_type = other RNA
nagtctaccatgtcgatgc

SEQ ID NO: 318 - RNA, 19 nt, synthetic construct
  source 1..19: mol_type = other RNA
nagtctaccatgtcgatgn

SEQ ID NO: 319 - RNA, 19 nt, synthetic construct
  source 1..19: mol_type = other RNA
agatcacgctgggacgtaa

SEQ ID NO: 320 - RNA, 19 nt, synthetic construct
  source 1..19: mol_type = other RNA
agatcacgctgggacgtat

SEQ ID NO: 321 - RNA, 19 nt, synthetic construct
  source 1..19: mol_type = other RNA
agatcacgctgggacgtac

SEQ ID NO: 322 - RNA, 19 nt, synthetic construct
  source 1..19: mol_type = other RNA
agatcacgctgggacgtan

SEQ ID NO: 323 - RNA, 19 nt, synthetic construct
  source 1..19: mol_type = other RNA
ngatcacgctgggacgtan

SEQ ID NO: 324 - RNA, 19 nt, synthetic construct
  source 1..19: mol_type = other RNA
gatcacgctgggacgtaca

SEQ ID NO: 325 - RNA, 19 nt, synthetic construct
  source 1..19: mol_type = other RNA
gatcacgctgggacgtact

SEQ ID NO: 326 - RNA, 19 nt, synthetic construct
  source 1..19: mol_type = other RNA
gatcacgctgggacgtacg

SEQ ID NO: 327 - RNA, 19 nt, synthetic construct
  source 1..19: mol_type = other RNA
gatcacgctgggacgtacn

SEQ ID NO: 328 - RNA, 19 nt, synthetic construct
  source 1..19: mol_type = other RNA
natcacgctgggacgtacn

SEQ ID NO: 329 - RNA, 19 nt, synthetic construct
  source 1..19: mol_type = other RNA
aagaccaagagggtgacaa

SEQ ID NO: 330 - RNA, 19 nt, synthetic construct
  source 1..19: mol_type = other RNA
aagaccaagagggtgacat

SEQ ID NO: 331 - RNA, 19 nt, synthetic construct
  source 1..19: mol_type = other RNA
aagaccaagagggtgacac

SEQ ID NO: 332 - RNA, 19 nt, synthetic construct
  source 1..19: mol_type = other RNA
aagaccaagagggtgacan

SEQ ID NO: 333 - RNA, 19 nt, synthetic construct
  source 1..19: mol_type = other RNA
nagaccaagagggtgacan

SEQ ID NO: 334 - RNA, 19 nt, synthetic construct
  source 1..19: mol_type = other RNA
agacgaagctgctggtcaa

SEQ ID NO: 335 - RNA, 19 nt, synthetic construct
  source 1..19: mol_type = other RNA
agacgaagctgctggtcat

SEQ ID NO: 336 - RNA, 19 nt, synthetic construct
  source 1..19: mol_type = other RNA
agacgaagctgctggtcac

SEQ ID NO: 337 - RNA, 19 nt, synthetic construct
  source 1..19: mol_type = other RNA
agacgaagctgctggtcan

SEQ ID NO: 338 - RNA, 19 nt, synthetic construct
  source 1..19: mol_type = other RNA
ngacgaagctgctggtcan

SEQ ID NO: 339 - RNA, 19 nt, synthetic construct
  source 1..19: mol_type = other RNA
gacccaagctcgcatggta

SEQ ID NO: 340 - RNA, 19 nt, synthetic construct
  source 1..19: mol_type = other RNA
gacccaagctcgcatggtt

SEQ ID NO: 341 - RNA, 19 nt, synthetic construct
  source 1..19: mol_type = other RNA
gacccaagctcgcatggtc

SEQ ID NO: 342 - RNA, 19 nt, synthetic construct
  source 1..19: mol_type = other RNA
gacccaagctcgcatggtn

SEQ ID NO: 343 - RNA, 19 nt, synthetic construct
  source 1..19: mol_type = other RNA
nacccaagctcgcatggtn

SEQ ID NO: 344 - RNA, 19 nt, synthetic construct
  source 1..19: mol_type = other RNA
aagctcgcatggtcagtat

SEQ ID NO: 345 - RNA, 19 nt, synthetic construct
  source 1..19: mol_type = other RNA
aagctcgcatggtcagtaa

SEQ ID NO: 346 - RNA, 19 nt, synthetic construct
  source 1..19: mol_type = other RNA
aagctcgcatggtcagtan

SEQ ID NO: 347 - RNA, 19 nt, synthetic construct
  source 1..19: mol_type = other RNA
nagctcgcatggtcagtan

SEQ ID NO: 348 - RNA, 19 nt, synthetic construct
  source 1..19: mol_type = other RNA
gctcgcatggtcagtaaat

SEQ ID NO: 349 - RNA, 19 nt, synthetic construct
  source 1..19: mol_type = other RNA
gctcgcatggtcagtaaaa

SEQ ID NO: 350 - RNA, 19 nt, synthetic construct
  source 1..19: mol_type = other RNA
gctcgcatggtcagtaaan

SEQ ID NO: 351 - RNA, 19 nt, synthetic construct
  source 1..19: mol_type = other RNA
nctcgcatggtcagtaaan

SEQ ID NO: 352 - RNA, 19 nt, synthetic construct
  source 1..19: mol_type = other RNA
tcgcatggtcagtaaaaga

SEQ ID NO: 353 - RNA, 19 nt, synthetic construct
  source 1..19: mol_type = other RNA
tcgcatggtcagtaaaagt

SEQ ID NO: 354 - RNA, 19 nt, synthetic construct
  source 1..19: mol_type = other RNA
tcgcatggtcagtaaaagc

SEQ ID NO: 355 - RNA, 19 nt, synthetic construct
  source 1..19: mol_type = other RNA
tcgcatggtcagtaaaagn

SEQ ID NO: 356 - RNA, 19 nt, synthetic construct
  source 1..19: mol_type = other RNA
ncgcatggtcagtaaaagn

SEQ ID NO: 357 - RNA, 19 nt, synthetic construct
  source 1..19: mol_type = other RNA
gcatggtcagtaaaagcat

SEQ ID NO: 358 - RNA, 19 nt, synthetic construct
  source 1..19: mol_type = other RNA
gcatggtcagtaaaagcaa

SEQ ID NO: 359 - RNA, 19 nt, synthetic construct
  source 1..19: mol_type = other RNA
gcatggtcagtaaaagcan

SEQ ID NO: 360 - RNA, 19 nt, synthetic construct
  source 1..19: mol_type = other RNA
ncatggtcagtaaaagcan

SEQ ID NO: 361 - RNA, 19 nt, synthetic construct
  source 1..19: mol_type = other RNA
catggtcagtaaaagcaat

SEQ ID NO: 362 - RNA, 19 nt, synthetic construct
  source 1..19: mol_type = other RNA
catggtcagtaaaagcaaa

SEQ ID NO: 363 - RNA, 19 nt, synthetic construct
  source 1..19: mol_type = other RNA
catggtcagtaaaagcaan

SEQ ID NO: 364 - RNA, 19 nt, synthetic construct
  source 1..19: mol_type = other RNA
natggtcagtaaaagcaan

SEQ ID NO: 365 - RNA, 19 nt, synthetic construct
  source 1..19: mol_type = other RNA
tcagtaaaagcaaagacga

SEQ ID NO: 366 - RNA, 19 nt, synthetic construct
  source 1..19: mol_type = other RNA
tcagtaaaagcaaagacgt

SEQ ID NO: 367 - RNA, 19 nt, synthetic construct
  source 1..19: mol_type = other RNA
tcagtaaaagcaaagacgg

SEQ ID NO: 368 - RNA, 19 nt, synthetic construct
  source 1..19: mol_type = other RNA
tcagtaaaagcaaagacgn

SEQ ID NO: 369 - RNA, 19 nt, synthetic construct
  source 1..19: mol_type = other RNA
ncagtaaaagcaaagacgn

SEQ ID NO: 370 - RNA, 19 nt, synthetic construct
  source 1..19: mol_type = other RNA
gactggaagcgatgacaat

SEQ ID NO: 371 - RNA, 19 nt, synthetic construct
  source 1..19: mol_type = other RNA
gactggaagcgatgacaaa

SEQ ID NO: 372 - RNA, 19 nt, synthetic construct
  source 1..19: mol_type = other RNA
gactggaagcgatgacaan

SEQ ID NO: 373 - RNA, 19 nt, synthetic construct
  source 1..19: mol_type = other RNA
nactggaagcgatgacaan

SEQ ID NO: 374 - RNA, 19 nt, synthetic construct
  source 1..19: mol_type = other RNA
ctggaagcgatgacaaaat

SEQ ID NO: 375 - RNA, 19 nt, synthetic construct
  source 1..19: mol_type = other RNA
ctggaagcgatgacaaaaa

SEQ ID NO: 376 - RNA, 19 nt, synthetic construct
  source 1..19: mol_type = other RNA
ctggaagcgatgacaaaan

SEQ ID NO: 377 - RNA, 19 nt, synthetic construct
  source 1..19: mol_type = other RNA
ntggaagcgatgacaaaan

SEQ ID NO: 378 - RNA, 19 nt, synthetic construct
  source 1..19: mol_type = other RNA
gaagcgatgacaaaaaaga

SEQ ID NO: 379 - RNA, 19 nt, synthetic construct
  source 1..19: mol_type = other RNA
gaagcgatgacaaaaaagt

SEQ ID NO: 380 - RNA, 19 nt, synthetic construct
  source 1..19: mol_type = other RNA
gaagcgatgacaaaaaagc

SEQ ID NO: 381 - RNA, 19 nt, synthetic construct
  source 1..19: mol_type = other RNA
gaagcgatgacaaaaaagn

SEQ ID NO: 382 - RNA, 19 nt, synthetic construct
  source 1..19: mol_type = other RNA
naagcgatgacaaaaaagn

SEQ ID NO: 383 - RNA, 19 nt, synthetic construct
  source 1..19: mol_type = other RNA
caggattccagcaaaaaca

SEQ ID NO: 384 - RNA, 19 nt, synthetic construct
  source 1..19: mol_type = other RNA
caggattccagcaaaaact

SEQ ID NO: 385 - RNA, 19 nt, synthetic construct
  source 1..19: mol_type = other RNA
caggattccagcaaaaacc

SEQ ID NO: 386 - RNA, 19 nt, synthetic construct
  source 1..19: mol_type = other RNA
caggattccagcaaaaacn

SEQ ID NO: 387 - RNA, 19 nt, synthetic construct
  source 1..19: mol_type = other RNA
naggattccagcaaaaacn

SEQ ID NO: 388 - RNA, 19 nt, synthetic construct
  source 1..19: mol_type = other RNA
aggattccagcaaaaacca

SEQ ID NO: 389 - RNA, 19 nt, synthetic construct
  source 1..19: mol_type = other RNA
aggattccagcaaaaacct

SEQ ID NO: 390 - RNA, 19 nt, synthetic construct
  source 1..19: mol_type = other RNA
aggattccagcaaaaaccc

SEQ ID NO: 391 - RNA, 19 nt, synthetic construct
  source 1..19: mol_type = other RNA
aggattccagcaaaaaccn

SEQ ID NO: 392 - RNA, 19 nt, synthetic construct
  source 1..19: mol_type = other RNA
nggattccagcaaaaaccn

SEQ ID NO: 393 - RNA, 19 nt, synthetic construct
  source 1..19: mol_type = other RNA
aagacaccacccagctcta

SEQ ID NO: 394 - RNA, 19 nt, synthetic construct
  source 1..19: mol_type = other RNA
aagacaccacccagctctt

SEQ ID NO: 395 - RNA, 19 nt, synthetic construct
  source 1..19: mol_type = other RNA
aagacaccacccagctctg

SEQ ID NO: 396 - RNA, 19 nt, synthetic construct
  source 1..19: mol_type = other RNA
aagacaccacccagctctn

SEQ ID NO: 397 - RNA, 19 nt, synthetic construct
  source 1..19: mol_type = other RNA
nagacaccacccagctctn

SEQ ID NO: 398 - RNA, 19 nt, synthetic construct
  source 1..19: mol_type = other RNA
tggtgaacctccaaaatct

SEQ ID NO: 399 - RNA, 19 nt, synthetic construct
  source 1..19: mol_type = other RNA
tggtgaacctccaaaatca

SEQ ID NO: 400 - RNA, 19 nt, synthetic construct
  source 1..19: mol_type = other RNA
tggtgaacctccaaaatcn

SEQ ID NO: 401 - RNA, 19 nt, synthetic construct
  source 1..19: mol_type = other RNA
nggtgaacctccaaaatcn

SEQ ID NO: 402 - RNA, 19 nt, synthetic construct
  source 1..19: mol_type = other RNA
ggtgaacctccaaaatcaa

SEQ ID NO: 403 - RNA, 19 nt, synthetic construct
  source 1..19: mol_type = other RNA
ggtgaacctccaaaatcat

SEQ ID NO: 404 - RNA, 19 nt, synthetic construct
  source 1..19: mol_type = other RNA
ggtgaacctccaaaatcag

SEQ ID NO: 405 - RNA, 19 nt, synthetic construct
  source 1..19: mol_type = other RNA
ggtgaacctccaaaatcan

SEQ ID NO: 406 - RNA, 19 nt, synthetic construct
  source 1..19: mol_type = other RNA
ngtgaacctccaaaatcan

SEQ ID NO: 407 - RNA, 19 nt, synthetic construct
  source 1..19: mol_type = other RNA
tgaacctccaaaatcagga

SEQ ID NO: 408 - RNA, 19 nt, synthetic construct
  source 1..19: mol_type = other RNA
tgaacctccaaaatcaggt

SEQ ID NO: 409 - RNA, 19 nt, synthetic construct
  source 1..19: mol_type = other RNA
tgaacctccaaaatcaggg

SEQ ID NO: 410 - RNA, 19 nt, synthetic construct
  source 1..19: mol_type = other RNA
tgaacctccaaaatcaggn

SEQ ID NO: 411 - RNA, 19 nt, synthetic construct
  source 1..19: mol_type = other RNA
ngaacctccaaaatcaggn

SEQ ID NO: 412 - RNA, 19 nt, synthetic construct
  source 1..19: mol_type = other RNA
caaaatcaggggatcgcaa

SEQ ID NO: 413 - RNA, 19 nt, synthetic construct
  source 1..19: mol_type = other RNA
caaaatcaggggatcgcat

SEQ ID NO: 414 - RNA, 19 nt, synthetic construct
  source 1..19: mol_type = other RNA
caaaatcaggggatcgcag

SEQ ID NO: 415 - RNA, 19 nt, synthetic construct
  source 1..19: mol_type = other RNA
caaaatcaggggatcgcan

SEQ ID NO: 416 - RNA, 19 nt, synthetic construct
  source 1..19: mol_type = other RNA
naaaatcaggggatcgcan

SEQ ID NO: 417 - RNA, 19 nt, synthetic construct
  source 1..19: mol_type = other RNA
gtgcaaatagtctacaaaa

SEQ ID NO: 418 - RNA, 19 nt, synthetic construct
  source 1..19: mol_type = other RNA
gtgcaaatagtctacaaat

SEQ ID NO: 419 - RNA, 19 nt, synthetic construct
  source 1..19: mol_type = other RNA
gtgcaaatagtctacaaac

SEQ ID NO: 420 - RNA, 19 nt, synthetic construct
  source 1..19: mol_type = other RNA
gtgcaaatagtctacaaan

SEQ ID NO: 421 - RNA, 19 nt, synthetic construct
  source 1..19: mol_type = other RNA
ntgcaaatagtctacaaan

SEQ ID NO: 422 - RNA, 19 nt, synthetic construct
  source 1..19: mol_type = other RNA
aatagtctacaaaccagta

SEQ ID NO: 423 - RNA, 19 nt, synthetic construct
  source 1..19: mol_type = other RNA
aatagtctacaaaccagtt

SEQ ID NO: 424 - RNA, 19 nt, synthetic construct
  source 1..19: mol_type = other RNA
aatagtctacaaaccagtn

SEQ ID NO: 425 - RNA, 19 nt, synthetic construct
  source 1..19: mol_type = other RNA
natagtctacaaaccagtn

SEQ ID NO: 426 - RNA, 19 nt, synthetic construct
  source 1..19: mol_type = other RNA
tagtctacaaaccagttgt

SEQ ID NO: 427 - RNA, 19 nt, synthetic construct
  source 1..19: mol_type = other RNA
tagtctacaaaccagttga

SEQ ID NO: 428 - RNA, 19 nt, synthetic construct
  source 1..19: mol_type = other RNA
tagtctacaaaccagttgn

SEQ ID NO: 429 - RNA, 19 nt, synthetic construct
  source 1..19: mol_type = other RNA
nagtctacaaaccagttgn

SEQ ID NO: 430 - RNA, 19 nt, synthetic construct
  source 1..19: mol_type = other RNA
agtctacaaaccagttgaa

SEQ ID NO: 431 - RNA, 19 nt, synthetic construct
  source 1..19: mol_type = other RNA
agtctacaaaccagttgat

SEQ ID NO: 432 - RNA, 19 nt, synthetic construct
  source 1..19: mol_type = other RNA
agtctacaaaccagttgac

SEQ ID NO: 433 - RNA, 19 nt, synthetic construct
  source 1..19: mol_type = other RNA
agtctacaaaccagttgan

SEQ ID NO: 434 - RNA, 19 nt, synthetic construct
  source 1..19: mol_type = other RNA
ngtctacaaaccagttgan

SEQ ID NO: 435 - RNA, 19 nt, synthetic construct
  source 1..19: mol_type = other RNA
tctacaaaccagttgacca

SEQ ID NO: 436 - RNA, 19 nt, synthetic construct
  source 1..19: mol_type = other RNA
tctacaaaccagttgacct

SEQ ID NO: 437 - RNA, 19 nt, synthetic construct
  source 1..19: mol_type = other RNA
tctacaaaccagttgaccn

SEQ ID NO: 438 - RNA, 19 nt, synthetic construct
  source 1..19: mol_type = other RNA
nctacaaaccagttgaccn

SEQ ID NO: 439 - RNA, 19 nt, synthetic construct
  source 1..19: mol_type = other RNA
ccagttgacctgagcaaga

SEQ ID NO: 440 - RNA, 19 nt, synthetic construct
  source 1..19: mol_type = other RNA
ccagttgacctgagcaagt

SEQ ID NO: 441 - RNA, 19 nt, synthetic construct
  source 1..19: mol_type = other RNA
ccagttgacctgagcaagg

SEQ ID NO: 442 - RNA, 19 nt, synthetic construct
  source 1..19: mol_type = other RNA
ccagttgacctgagcaagn

SEQ ID NO: 443 - RNA, 19 nt, synthetic construct
  source 1..19: mol_type = other RNA
ncagttgacctgagcaagn

SEQ ID NO: 444 - RNA, 19 nt, synthetic construct
  source 1..19: mol_type = other RNA
gttgacctgagcaaggtgt

SEQ ID NO: 445 - RNA, 19 nt, synthetic construct
  source 1..19: mol_type = other RNA
gttgacctgagcaaggtga

SEQ ID NO: 446 - RNA, 19 nt, synthetic construct
  source 1..19: mol_type = other RNA
gttgacctgagcaaggtgn

SEQ ID NO: 447 - RNA, 19 nt, synthetic construct
  source 1..19: mol_type = other RNA
nttgacctgagcaaggtgn

SEQ ID NO: 448 - RNA, 19 nt, synthetic construct
  source 1..19: mol_type = other RNA
aaggtgacctccaagtgta

SEQ ID NO: 449 - RNA, 19 nt, synthetic construct
  source 1..19: mol_type = other RNA
aaggtgacctccaagtgtt

SEQ ID NO: 450 - RNA, 19 nt, synthetic construct
  source 1..19: mol_type = other RNA
aaggtgacctccaagtgtg

SEQ ID NO: 451 - RNA, 19 nt, synthetic construct
  source 1..19: mol_type = other RNA
aaggtgacctccaagtgtn

SEQ ID NO: 452 - RNA, 19 nt, synthetic construct
  source 1..19: mol_type = other RNA
naggtgacctccaagtgtn

SEQ ID NO: 453 - RNA, 19 nt, synthetic construct
  source 1..19: mol_type = other RNA
ctccaagtgtggctcattt

SEQ ID NO: 454 - RNA, 19 nt, synthetic construct
  source 1..19: mol_type = other RNA
ctccaagtgtggctcatta

SEQ ID NO: 455 - RNA, 19 nt, synthetic construct
  source 1..19: mol_type = other RNA
ctccaagtgtggctcattn

SEQ ID NO: 456 - RNA, 19 nt, synthetic construct
  source 1..19: mol_type = other RNA
ntccaagtgtggctcattn

SEQ ID NO: 457 - RNA, 19 nt, synthetic construct
  source 1..19: mol_type = other RNA
tccaagtgtggctcattaa

SEQ ID NO: 458 - RNA, 19 nt, synthetic construct
  source 1..19: mol_type = other RNA
tccaagtgtggctcattat

SEQ ID NO: 459 - RNA, 19 nt, synthetic construct
  source 1..19: mol_type = other RNA
tccaagtgtggctcattag

SEQ ID NO: 460 - RNA, 19 nt, synthetic construct
  source 1..19: mol_type = other RNA
tccaagtgtggctcattan

SEQ ID NO: 461 - RNA, 19 nt, synthetic construct
  source 1..19: mol_type = other RNA
nccaagtgtggctcattan

SEQ ID NO: 462 - RNA, 19 nt, synthetic construct
  source 1..19: mol_type = other RNA
ccaagtgtggctcattaga

SEQ ID NO: 463 - RNA, 19 nt, synthetic construct
  source 1..19: mol_type = other RNA
ccaagtgtggctcattagt

SEQ ID NO: 464 - RNA, 19 nt, synthetic construct
  source 1..19: mol_type = other RNA
ccaagtgtggctcattagg

SEQ ID NO: 465 - RNA, 19 nt, synthetic construct
  source 1..19: mol_type = other RNA
ccaagtgtggctcattagn

SEQ ID NO: 466 - RNA, 19 nt, synthetic construct
  source 1..19: mol_type = other RNA
ncaagtgtggctcattagn

SEQ ID NO: 467 - RNA, 19 nt, synthetic construct
  source 1..19: mol_type = other RNA
caagtgtggctcattagga

SEQ ID NO: 468 - RNA, 19 nt, synthetic construct
  source 1..19: mol_type = other RNA
caagtgtggctcattaggt

SEQ ID NO: 469 - RNA, 19 nt, synthetic construct
  source 1..19: mol_type = other RNA
caagtgtggctcattaggc

SEQ ID NO: 470 - RNA, 19 nt, synthetic construct
  source 1..19: mol_type = other RNA
caagtgtggctcattaggn

SEQ ID NO: 471 - RNA, 19 nt, synthetic construct
  source 1..19: mol_type = other RNA
naagtgtggctcattaggn

SEQ ID NO: 472 - RNA, 19 nt, synthetic construct
  source 1..19: mol_type = other RNA
aagtgtggctcattaggct

SEQ ID NO: 473 - RNA, 19 nt, synthetic construct
  source 1..19: mol_type = other RNA
aagtgtggctcattaggca

SEQ ID NO: 474 - RNA, 19 nt, synthetic construct
  source 1..19: mol_type = other RNA
aagtgtggctcattaggcn

SEQ ID NO: 475 - RNA, 19 nt, synthetic construct
  source 1..19: mol_type = other RNA
nagtgtggctcattaggcn

SEQ ID NO: 476 - RNA, 19 nt, synthetic construct
  source 1..19: mol_type = other RNA
ggctcattaggcaacatca

SEQ ID NO: 477 - RNA, 19 nt, synthetic construct
  source 1..19: mol_type = other RNA
ggctcattaggcaacatct

SEQ ID NO: 478 - RNA, 19 nt, synthetic construct
  source 1..19: mol_type = other RNA
ggctcattaggcaacatcc

SEQ ID NO: 479 - RNA, 19 nt, synthetic construct
  source 1..19: mol_type = other RNA
ggctcattaggcaacatcn

SEQ ID NO: 480 - RNA, 19 nt, synthetic construct
  source 1..19: mol_type = other RNA
ngctcattaggcaacatcn

SEQ ID NO: 481 - RNA, 19 nt, synthetic construct
  source 1..19: mol_type = other RNA
taggcaacatccatcatat

SEQ ID NO: 482 - RNA, 19 nt, synthetic construct
  source 1..19: mol_type = other RNA
taggcaacatccatcataa

SEQ ID NO: 483 - RNA, 19 nt, synthetic construct
  source 1..19: mol_type = other RNA
taggcaacatccatcatan

SEQ ID NO: 484 - RNA, 19 nt, synthetic construct
  source 1..19: mol_type = other RNA
naggcaacatccatcatan

SEQ ID NO: 485 - RNA, 19 nt, synthetic construct
  source 1..19: mol_type = other RNA
aggcaacatccatcataat

SEQ ID NO: 486 - RNA, 19 nt, synthetic construct
  source 1..19: mol_type = other RNA
aggcaacatccatcataaa

SEQ ID NO: 487 - RNA, 19 nt, synthetic construct
  source 1..19: mol_type = other RNA
aggcaacatccatcataan

SEQ ID NO: 488 - RNA, 19 nt, synthetic construct
  source 1..19: mol_type = other RNA
nggcaacatccatcataan

SEQ ID NO: 489 - RNA, 19 nt, synthetic construct
  source 1..19: mol_type = other RNA
gcaacatccatcataaaca

SEQ ID NO: 490 - RNA, 19 nt, synthetic construct
  source 1..19: mol_type = other RNA
gcaacatccatcataaact

SEQ ID NO: 491 - RNA, 19 nt, synthetic construct
  source 1..19: mol_type = other RNA
gcaacatccatcataaacc

SEQ ID NO: 492 - RNA, 19 nt, synthetic construct
  source 1..19: mol_type = other RNA
gcaacatccatcataaacn

SEQ ID NO: 493 - RNA, 19 nt, synthetic construct
  source 1..19: mol_type = other RNA
ncaacatccatcataaacn

SEQ ID NO: 494 - RNA, 19 nt, synthetic construct
  source 1..19: mol_type = other RNA
gtggccaggtggaagtaat

SEQ ID NO: 495 - RNA, 19 nt, synthetic construct
  source 1..19: mol_type = other RNA
gtggccaggtggaagtaaa

SEQ ID NO: 496 - RNA, 19 nt, synthetic construct
  source 1..19: mol_type = other RNA
gtggccaggtggaagtaan

SEQ ID NO: 497 - RNA, 19 nt, synthetic construct
  source 1..19: mol_type = other RNA
ntggccaggtggaagtaan

SEQ ID NO: 498 - RNA, 19 nt, synthetic construct
  source 1..19: mol_type = other RNA
ccaggtggaagtaaaatca

SEQ ID NO: 499 - RNA, 19 nt, synthetic construct
  source 1..19: mol_type = other RNA
ccaggtggaagtaaaatct

SEQ ID NO: 500 - RNA, 19 nt, synthetic construct
  source 1..19: mol_type = other RNA
ccaggtggaagtaaaatcn

SEQ ID NO: 501 - RNA, 19 nt, synthetic construct
  source 1..19: mol_type = other RNA
ncaggtggaagtaaaatcn

SEQ ID NO: 502 - RNA, 19 nt, synthetic construct
  source 1..19: mol_type = other RNA
caggtggaagtaaaatcta

SEQ ID NO: 503 - RNA, 19 nt, synthetic construct
  source 1..19: mol_type = other RNA
caggtggaagtaaaatctt

SEQ ID NO: 504 - RNA, 19 nt, synthetic construct
  source 1..19: mol_type = other RNA
caggtggaagtaaaatctg

SEQ ID NO: 505 - RNA, 19 nt, synthetic construct
  source 1..19: mol_type = other RNA
caggtggaagtaaaatctn

SEQ ID NO: 506 - RNA, 19 nt, synthetic construct
  source 1..19: mol_type = other RNA
naggtggaagtaaaatctn

SEQ ID NO: 507 - RNA, 19 nt, synthetic construct
  source 1..19: mol_type = other RNA
ggtccctggacaatatcaa

SEQ ID NO: 508 - RNA, 19 nt, synthetic construct
  source 1..19: mol_type = other RNA
ggtccctggacaatatcat

SEQ ID NO: 509 - RNA, 19 nt, synthetic construct
  source 1..19: mol_type = other RNA
ggtccctggacaatatcac

SEQ ID NO: 510 - RNA, 19 nt, synthetic construct
  source 1..19: mol_type = other RNA
ggtccctggacaatatcan

SEQ ID NO: 511 - RNA, 19 nt, synthetic construct
  source 1..19: mol_type = other RNA
ngtccctggacaatatcan

SEQ ID NO: 512 - RNA, 19 nt, synthetic construct
  source 1..19: mol_type = other RNA
tccctggacaatatcacca

SEQ ID NO: 513 - RNA, 19 nt, synthetic construct
  source 1..19: mol_type = other RNA
tccctggacaatatcacct

SEQ ID NO: 514 - RNA, 19 nt, synthetic construct
  source 1..19: mol_type = other RNA
tccctggacaatatcaccc

SEQ ID NO: 515 - RNA, 19 nt, synthetic construct
  source 1..19: mol_type = other RNA
tccctggacaatatcaccn

SEQ ID NO: 516 - RNA, 19 nt, synthetic construct
  source 1..19: mol_type = other RNA
nccctggacaatatcaccn

SEQ ID NO: 517 - RNA, 19 nt, synthetic construct
  source 1..19: mol_type = other RNA
agattgaaacccacaagca

SEQ ID NO: 518 - RNA, 19 nt, synthetic construct
  source 1..19: mol_type = other RNA
agattgaaacccacaagct

SEQ ID NO: 519 - RNA, 19 nt, synthetic construct
  source 1..19: mol_type = other RNA
agattgaaacccacaagcn

SEQ ID NO: 520 - RNA, 19 nt, synthetic construct
  source 1..19: mol_type = other RNA
ngattgaaacccacaagcn

SEQ ID NO: 521 - RNA, 19 nt, synthetic construct
  source 1..19: mol_type = other RNA
attgaaacccacaagctgt

SEQ ID NO: 522 - RNA, 19 nt, synthetic construct
  source 1..19: mol_type = other RNA
attgaaacccacaagctga

SEQ ID NO: 523 - RNA, 19 nt, synthetic construct
  source 1..19: mol_type = other RNA
attgaaacccacaagctgn

SEQ ID NO: 524 - RNA, 19 nt, synthetic construct
  source 1..19: mol_type = other RNA
nttgaaacccacaagctgn

SEQ ID NO: 525 - RNA, 19 nt, synthetic construct
  source 1..19: mol_type = other RNA
ttgaaacccacaagctgaa

SEQ ID NO: 526 - RNA, 19 nt, synthetic construct
  source 1..19: mol_type = other RNA
ttgaaacccacaagctgat

SEQ ID NO: 527 - RNA, 19 nt, synthetic construct
  source 1..19: mol_type = other RNA
ttgaaacccacaagctgac

SEQ ID NO: 528 - RNA, 19 nt, synthetic construct
  source 1..19: mol_type = other RNA
ttgaaacccacaagctgan

SEQ ID NO: 529 - RNA, 19 nt, synthetic construct
  source 1..19: mol_type = other RNA
ntgaaacccacaagctgan

SEQ ID NO: 530 - DNA, 19 bp, synthetic construct
  source 1..19: mol_type = other DNA
gccaaagccaagacagaca

SEQ ID NO: 531 - RNA, 19 nt, synthetic construct
  source 1..19: mol_type = other RNA
gccaaagccaagacagact

SEQ ID NO: 532 - DNA, 19 bp, synthetic construct
  source 1..19: mol_type = other DNA
gccaaagccaagacagacc

SEQ ID NO: 533 - DNA, 19 bp, synthetic construct
  source 1..19: mol_type = other DNA
gccaaagccaagacagacn

SEQ ID NO: 534 - DNA, 19 bp, synthetic construct
  source 1..19: mol_type = other DNA
nccaaagccaagacagacn

SEQ ID NO: 535 - RNA, 19 nt, synthetic construct
  source 1..19: mol_type = other RNA
cagcatcgacatggtagaa

SEQ ID NO: 536 - RNA, 19 nt, synthetic construct
  source 1..19: mol_type = other RNA
cagcatcgacatggtagat

SEQ ID NO: 537 - RNA, 19 nt, synthetic construct
  source 1..19: mol_type = other RNA
cagcatcgacatggtagac

SEQ ID NO: 538 - RNA, 19 nt, synthetic construct
  source 1..19: mol_type = other RNA
cagcatcgacatggtagan

SEQ ID NO: 539 - RNA, 19 nt, synthetic construct
  source 1..19: mol_type = other RNA
nagcatcgacatggtagan

SEQ ID NO: 540 - RNA, 19 nt, synthetic construct
  source 1..19: mol_type = other RNA
gcatcgacatggtagacta

SEQ ID NO: 541 - RNA, 19 nt, synthetic construct
  source 1..19: mol_type = other RNA
gcatcgacatggtagactt

SEQ ID NO: 542 - RNA, 19 nt, synthetic construct
  source 1..19: mol_type = other RNA
gcatcgacatggtagactc

SEQ ID NO: 543 - RNA, 19 nt, synthetic construct
  source 1..19: mol_type = other RNA
gcatcgacatggtagactn

SEQ ID NO: 544 - RNA, 19 nt, synthetic construct
  source 1..19: mol_type = other RNA
ncatcgacatggtagactn

SEQ ID NO: 545 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tagtctaccatgttgatgctg

SEQ ID NO: 546 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tagtctactatgtcgatgctg

SEQ ID NO: 547 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = OTHER; note = 2',3'-seco-cytidine
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tagtctaccatgtcgatgctg

SEQ ID NO: 548 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = OTHER; note = 2',3'-seco-uridine
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tagtctaccatgtcgatgctg

SEQ ID NO: 549 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2 -deoxyadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tagtctaccatgtcgatgctg

SEQ ID NO: 550 - RNA, 23 nt, synthetic construct
  modified_base 1: mod_base = OTHER; note = vinyl phosphonate 2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 4: mod_base = cm
  modified_base 5: mod_base = OTHER; note = 2 -deoxyadenosine
  modified_base 6: mod_base = um
  modified_base 7: mod_base = OTHER; note = 2 -deoxyadenosine
  modified_base 8: mod_base = cm
  modified_base 9: mod_base = gm
  modified_base 10: mod_base = OTHER; note = 2'-O-methyladenosine
  modified_base 11: mod_base = gm
  modified_base 12: mod_base = cm
  modified_base 13: mod_base = um
  modified_base 14: mod_base = OTHER; note = 2'-fluorouridine
  modified_base 15: mod_base = gm
  modified_base 16: mod_base = OTHER; note = 2'-fluoroguanosine
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = cm
  modified_base 21^22: mod_base = OTHER; note = phosphorothioate linkage
  modified_base 22: mod_base = gm
  modified_base 22^23: mod_base = OTHER; note = phosphorothioate linkage
  modified_base 23: mod_base = um
  source 1..23: mol_type = other RNA
taccatacgagcttgggtcacgt

SEQ ID NO: 551 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = OTHER; note = 2',3'-seco-uridine
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tagtctaccatgttgatgctg

SEQ ID NO: 552 - RNA, 21 nt, synthetic construct
  modified_base 14: mod_base = OTHER; note = thymine
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-deoxythymidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tagtctaccatgttgatgctg

SEQ ID NO: 553 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = cm
  modified_base 5: mod_base = um
  modified_base 6: mod_base = OTHER; note = 2',3'-seco-uridine
  modified_base 7: mod_base = OTHER; note = 2'-fluorouridine
  modified_base 8: mod_base = um
  modified_base 9: mod_base = OTHER; note = 2'-O-methyladenosine
  modified_base 10: mod_base = cm
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = gm
  modified_base 20^21: mod_base = OTHER; note = phosphorodithioate linkage
  modified_base 21: mod_base = OTHER; note = 2'-O-methyladenosine
  source 1..21: mol_type = other RNA
ttgcttttactgaccatgcga

SEQ ID NO: 554 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = gm
  modified_base 6: mod_base = OTHER; note = 2'-fluorouridine
  modified_base 7: mod_base = cm
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = gm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = um
  modified_base 18: mod_base = OTHER; note = 2'-fluorocytidine
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
ttacgtcccagcgtgatcttc

SEQ ID NO: 555 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorocytidine
  modified_base 7: mod_base = OTHER; note = 2'-O-methyladenosine
  modified_base 8: mod_base = gm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = um
  modified_base 18: mod_base = OTHER; note = 2'-fluorocytidine
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
ttgaccagcagcttcgtcttc

SEQ ID NO: 556 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluoroguanosine
  modified_base 15: mod_base = OTHER; note = 2'-O-methyladenosine
  modified_base 16: mod_base = OTHER; note = 2'-fluoroguanosine
  modified_base 17: mod_base = cm
  modified_base 18: mod_base = OTHER; note = 2'-fluorouridine
  modified_base 19: mod_base = um
  modified_base 20: mod_base = gm
  modified_base 20^21: mod_base = OTHER; note = phosphorothioate linkage
  modified_base 21: mod_base = gm
  source 1..21: mol_type = other RNA
ttactgaccatgcgagcttgg

SEQ ID NO: 557 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = cm
  modified_base 6: mod_base = OTHER; note = 2'-fluorouridine
  modified_base 7: mod_base = um
  modified_base 8: mod_base = um
  modified_base 9: mod_base = um
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = gm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorouridine
  modified_base 19: mod_base = gm
  modified_base 20: mod_base = cm
  modified_base 20^21: mod_base = OTHER; note = phosphorothioate linkage
  modified_base 21: mod_base = gm
  source 1..21: mol_type = other RNA
tttgcttttactgaccatgcg

SEQ ID NO: 558 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = um
  modified_base 9: mod_base = gm
  modified_base 10: mod_base = cm
  modified_base 11: mod_base = um
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tcgtctttgcttttactgacc

SEQ ID NO: 559 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = cm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluoroguanosine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluoroadenosine
  modified_base 19: mod_base = gm
  modified_base 20: mod_base = um
  modified_base 20^21: mod_base = OTHER; note = phosphorothioate linkage
  modified_base 21: mod_base = cm
  source 1..21: mol_type = other RNA
tttttgtcatcgcttccagtc

SEQ ID NO: 560 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = um
  modified_base 8: mod_base = um
  modified_base 9: mod_base = gm
  modified_base 10: mod_base = um
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluorocytidine
  modified_base 17: mod_base = um
  modified_base 18: mod_base = OTHER; note = 2'-fluorouridine
  modified_base 19: mod_base = cm
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
tcttttttgtcatcgcttcca

SEQ ID NO: 561 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = um
  modified_base 8: mod_base = gm
  modified_base 9: mod_base = cm
  modified_base 10: mod_base = um
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorouridine
  modified_base 19: mod_base = gm
  modified_base 20: mod_base = gm
  modified_base 20^21: mod_base = OTHER; note = phosphorothioate linkage
  modified_base 21: mod_base = um
  source 1..21: mol_type = other RNA
tgtttttgctggaatcctggt

SEQ ID NO: 562 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = um
  modified_base 8: mod_base = gm
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluoroadenosine
  modified_base 17: mod_base = cm
  modified_base 18: mod_base = OTHER; note = 2'-fluorocytidine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
tgattttggaggttcaccaga

SEQ ID NO: 563 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = um
  modified_base 8: mod_base = um
  modified_base 9: mod_base = um
  modified_base 10: mod_base = um
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluoroguanosine
  modified_base 15: mod_base = gm
  modified_base 16: mod_base = OTHER; note = 2'-fluorouridine
  modified_base 17: mod_base = um
  modified_base 18: mod_base = OTHER; note = 2'-fluorocytidine
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tcctgattttggaggttcacc

SEQ ID NO: 564 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorocytidine
  modified_base 5: mod_base = gm
  modified_base 6: mod_base = OTHER; note = 2'-fluoroadenosine
  modified_base 7: mod_base = um
  modified_base 8: mod_base = cm
  modified_base 9: mod_base = cm
  modified_base 10: mod_base = cm
  modified_base 11: mod_base = cm
  modified_base 12: mod_base = OTHER; note = 2'-fluorouridine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = gm
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgcgatcccctgattttgga

SEQ ID NO: 565 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroguanosine
  modified_base 7: mod_base = um
  modified_base 8: mod_base = um
  modified_base 9: mod_base = um
  modified_base 10: mod_base = gm
  modified_base 11: mod_base = um
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = cm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorouridine
  modified_base 19: mod_base = um
  modified_base 20: mod_base = um
  modified_base 20^21: mod_base = OTHER; note = phosphorothioate linkage
  modified_base 21: mod_base = gm
  source 1..21: mol_type = other RNA
aactggtttgtagactatttg

SEQ ID NO: 566 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = gm
  modified_base 8: mod_base = gm
  modified_base 9: mod_base = um
  modified_base 10: mod_base = um
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-fluorouridine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = um
  source 1..21: mol_type = other RNA
tcaactggtttgtagactatt

SEQ ID NO: 567 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = gm
  modified_base 9: mod_base = gm
  modified_base 10: mod_base = um
  modified_base 11: mod_base = um
  modified_base 12: mod_base = OTHER; note = 2'-fluorouridine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluorocytidine
  modified_base 19: mod_base = um
  modified_base 20: mod_base = OTHER; note = 2'-O-methyladenosine
  modified_base 20^21: mod_base = OTHER; note = phosphorothioate linkage
  modified_base 21: mod_base = um
  source 1..21: mol_type = other RNA
ttcaactggtttgtagactat

SEQ ID NO: 568 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroadenosine
  modified_base 7: mod_base = OTHER; note = 2'-O-methyladenosine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = um
  source 1..21: mol_type = other RNA
aggtcaactggtttgtagact

SEQ ID NO: 569 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluorocytidine
  modified_base 7: mod_base = um
  modified_base 8: mod_base = cm
  modified_base 9: mod_base = OTHER; note = 2'-O-methyladenosine
  modified_base 10: mod_base = gm
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = gm
  modified_base 20: mod_base = um
  modified_base 20^21: mod_base = OTHER; note = phosphorothioate linkage
  modified_base 21: mod_base = um
  source 1..21: mol_type = other RNA
tcttgctcaggtcaactggtt

SEQ ID NO: 570 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = gm
  modified_base 8: mod_base = cm
  modified_base 9: mod_base = cm
  modified_base 10: mod_base = OTHER; note = 2'-O-methyladenosine
  modified_base 11: mod_base = cm
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = OTHER; note = 2'-fluoroadenosine
  modified_base 19: mod_base = gm
  modified_base 20: mod_base = gm
  modified_base 20^21: mod_base = OTHER; note = phosphorothioate linkage
  modified_base 21: mod_base = um
  source 1..21: mol_type = other RNA
taatgagccacacttggaggt

SEQ ID NO: 571 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorouridine
  modified_base 7: mod_base = gm
  modified_base 8: mod_base = OTHER; note = 2'-O-methyladenosine
  modified_base 9: mod_base = gm
  modified_base 10: mod_base = cm
  modified_base 11: mod_base = cm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluoroguanosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tctaatgagccacacttggag

SEQ ID NO: 572 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = gm
  modified_base 9: mod_base = OTHER; note = 2'-O-methyladenosine
  modified_base 10: mod_base = gm
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluorouridine
  modified_base 19: mod_base = gm
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
tcctaatgagccacacttgga

SEQ ID NO: 573 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroadenosine
  modified_base 7: mod_base = OTHER; note = 2'-O-methyladenosine
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluoroadenosine
  modified_base 17: mod_base = cm
  modified_base 18: mod_base = OTHER; note = 2'-fluorouridine
  modified_base 19: mod_base = um
  modified_base 20: mod_base = gm
  modified_base 20^21: mod_base = OTHER; note = phosphorothioate linkage
  modified_base 21: mod_base = gm
  source 1..21: mol_type = other RNA
tgcctaatgagccacacttgg

SEQ ID NO: 574 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluorouridine
  modified_base 7: mod_base = um
  modified_base 8: mod_base = gm
  modified_base 9: mod_base = cm
  modified_base 10: mod_base = cm
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = gm
  modified_base 18: mod_base = OTHER; note = 2'-fluorocytidine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tgatgttgcctaatgagccac

SEQ ID NO: 575 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = um
  modified_base 8: mod_base = gm
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorouridine
  modified_base 15: mod_base = gm
  modified_base 16: mod_base = OTHER; note = 2'-fluorocytidine
  modified_base 17: mod_base = cm
  modified_base 18: mod_base = OTHER; note = 2'-fluorouridine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = um
  source 1..21: mol_type = other RNA
ttatgatggatgttgcctaat

SEQ ID NO: 576 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = um
  modified_base 9: mod_base = gm
  modified_base 10: mod_base = gm
  modified_base 11: mod_base = OTHER; note = 2'-O-methyladenosine
  modified_base 12: mod_base = OTHER; note = 2'-fluorouridine
  modified_base 13: mod_base = gm
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = cm
  modified_base 18: mod_base = OTHER; note = 2'-fluorocytidine
  modified_base 19: mod_base = um
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttatgatggatgttgcctac

SEQ ID NO: 577 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroadenosine
  modified_base 7: mod_base = um
  modified_base 8: mod_base = gm
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = um
  modified_base 18: mod_base = OTHER; note = 2'-fluoroguanosine
  modified_base 19: mod_base = cm
  modified_base 20: mod_base = cm
  modified_base 20^21: mod_base = OTHER; note = phosphorothioate linkage
  modified_base 21: mod_base = um
  source 1..21: mol_type = other RNA
tgtttatgatggatgttgcct

SEQ ID NO: 578 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = cm
  modified_base 10: mod_base = um
  modified_base 11: mod_base = um
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = gm
  modified_base 20: mod_base = cm
  modified_base 20^21: mod_base = OTHER; note = phosphorothioate linkage
  modified_base 21: mod_base = cm
  source 1..21: mol_type = other RNA
agattttacttccacctggcc

SEQ ID NO: 579 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = um
  modified_base 8: mod_base = gm
  modified_base 9: mod_base = gm
  modified_base 10: mod_base = gm
  modified_base 11: mod_base = um
  modified_base 12: mod_base = OTHER; note = 2'-fluorouridine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = um
  modified_base 18: mod_base = OTHER; note = 2'-fluorocytidine
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
agcttgtgggtttcaatcttc

SEQ ID NO: 580 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = cm
  modified_base 6: mod_base = OTHER; note = 2'-fluorouridine
  modified_base 7: mod_base = um
  modified_base 8: mod_base = gm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroadenosine
  modified_base 19: mod_base = um
  modified_base 20: mod_base = cm
  modified_base 20^21: mod_base = OTHER; note = phosphorothioate linkage
  modified_base 21: mod_base = um
  source 1..21: mol_type = other RNA
tcagcttgtgggtttcaatct

SEQ ID NO: 581 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorocytidine
  modified_base 7: mod_base = um
  modified_base 8: mod_base = um
  modified_base 9: mod_base = gm
  modified_base 10: mod_base = um
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = cm
  modified_base 18: mod_base = OTHER; note = 2'-fluoroadenosine
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
ttcagcttgtgggtttcaatc

SEQ ID NO: 582 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = um
  modified_base 8: mod_base = cm
  modified_base 9: mod_base = um
  modified_base 10: mod_base = um
  modified_base 11: mod_base = gm
  modified_base 12: mod_base = OTHER; note = 2'-fluoroguanosine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = gm
  modified_base 18: mod_base = OTHER; note = 2'-fluoroguanosine
  modified_base 19: mod_base = cm
  modified_base 20: mod_base = gm
  modified_base 20^21: mod_base = OTHER; note = phosphorothioate linkage
  modified_base 21: mod_base = um
  source 1..21: mol_type = other RNA
tgtctgtcttggctttggcgt

SEQ ID NO: 583 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = OTHER; note = 2'-O-methyladenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = OTHER; note = 2'-fluoroguanosine
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 584 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 4: mod_base = cm
  modified_base 5: mod_base = um
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluoroadenosine
  modified_base 17: mod_base = cm
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = gm
  source 1..21: mol_type = other RNA
tgcctaatgagccacacttgg

SEQ ID NO: 585 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = um
  modified_base 5: mod_base = OTHER; note = 2'-fluorocytidine
  modified_base 6: mod_base = um
  modified_base 7: mod_base = OTHER; note = 2'-O-methyladenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 586 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 587 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = um
  modified_base 5: mod_base = cm
  modified_base 6: mod_base = um
  modified_base 7: mod_base = OTHER; note = 2'-O-methyladenosine
  modified_base 8: mod_base = cm
  modified_base 9: mod_base = OTHER; note = 2'-fluorocytidine
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 588 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 589 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 590 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = um
  modified_base 5: mod_base = cm
  modified_base 6: mod_base = um
  modified_base 7: mod_base = OTHER; note = 2'-O-methyladenosine
  modified_base 8: mod_base = cm
  modified_base 9: mod_base = OTHER; note = 2'-fluorocytidine
  modified_base 10: mod_base = OTHER; note = 2'-O-methyladenosine
  modified_base 11: mod_base = um
  modified_base 12: mod_base = gm
  modified_base 13: mod_base = um
  modified_base 14: mod_base = OTHER; note = 2'-fluorocytidine
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 591 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = gm
  modified_base 13: mod_base = um
  modified_base 14: mod_base = OTHER; note = 2'-fluorocytidine
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 592 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tagtctaccatgtcgatgctg

SEQ ID NO: 593 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 19^20: mod_base = OTHER; note = phosphorothioate linkage
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 594 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2',3'-seco-adenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 595 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2 -deoxyadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2 -deoxyadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 596 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2 -deoxyadenosine
  modified_base 8: mod_base = cm
  modified_base 9: mod_base = cm
  modified_base 10: mod_base = OTHER; note = 2'-O-methyladenosine
  modified_base 11: mod_base = um
  modified_base 12: mod_base = OTHER; note = 2 -deoxyguanosine
  modified_base 13: mod_base = um
  modified_base 14: mod_base = OTHER; note = 2'-fluorocytidine
  modified_base 15: mod_base = gm
  modified_base 16: mod_base = OTHER; note = 2 -deoxyadenosine
  modified_base 17: mod_base = um
  modified_base 18: mod_base = gm
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
tagtctaccatgtcgatgctg

SEQ ID NO: 597 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = um
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgatatggtagacta

SEQ ID NO: 598 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 599 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 600 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 601 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = OTHER; note = 2'-O-hexadecanyluridine
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 602 - RNA, 21 nt, synthetic construct
  modified_base 1: mod_base = gm
  modified_base 1^2: mod_base = OTHER; note = phosphorothioate linkage
  modified_base 2: mod_base = um
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-hexadecanylcytidine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = cm
  modified_base 14: mod_base = gm
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 19^20: mod_base = OTHER; note = phosphorothioate linkage
  modified_base 20: mod_base = um
  modified_base 20^21: mod_base = OTHER; note = phosphorothioate linkage
  modified_base 21: mod_base = OTHER; note = 2'-O-methyladenosine
  source 1..21: mol_type = other RNA
gtgacccaagctcgtatggta

SEQ ID NO: 603 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = OTHER; note = 2'-fluoroguanosine
  modified_base 8: mod_base = um
  modified_base 9: mod_base = OTHER; note = 2'-fluoroguanosine
  modified_base 10: mod_base = gm
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = um
  modified_base 17: mod_base = OTHER; note = 2'-O-methyladenosine
  modified_base 18: mod_base = gm
  modified_base 19: mod_base = gm
  modified_base 20: mod_base = um
  modified_base 21: mod_base = OTHER; note = 2'-O-methyladenosine
  source 1..21: mol_type = other RNA
ccaagtgtggctcattaggta

SEQ ID NO: 604 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcaacatggtagacta

SEQ ID NO: 605 - RNA, 21 nt, synthetic construct
  modified_base 1: mod_base = um
  modified_base 2: mod_base = cm
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = gm
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
tcgcatggtcagtaaaagcaa

SEQ ID NO: 606 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 607 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 608 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = gm
  modified_base 16: mod_base = OTHER; note = 2'-O-methyladenosine
  modified_base 17: mod_base = cm
  modified_base 18: mod_base = OTHER; note = 2 -O-methylinosine
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
gaagatcacgctgggacntaa

SEQ ID NO: 609 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
gaagatcacgctgggatgtaa

SEQ ID NO: 610 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = cm
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = cm
  modified_base 15: mod_base = um
  modified_base 16: mod_base = OTHER; note = 2 -O-methylinosine
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
gaagacgaagctgctngtcaa

SEQ ID NO: 611 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = cm
  modified_base 7: mod_base = um
  modified_base 8: mod_base = cm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
ccaagctcgcatggtcagtaa

SEQ ID NO: 612 - RNA, 21 nt, synthetic construct
  modified_base 1: mod_base = cm
  modified_base 2: mod_base = gm
  modified_base 3: mod_base = cm
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
cgcatggtcagtaaaagcaaa

SEQ ID NO: 613 - RNA, 21 nt, synthetic construct
  modified_base 1: mod_base = gm
  modified_base 2: mod_base = gm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroadenosine
  modified_base 12: mod_base = gm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = OTHER; note = 2 -O-methylinosine
  modified_base 21: mod_base = OTHER; note = 2'-O-methyladenosine
  source 1..21: mol_type = other RNA
ggtcagtaaaagcaaagacna

SEQ ID NO: 614 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gactggaagcgatgacaaaaa

SEQ ID NO: 615 - RNA, 21 nt, synthetic construct
  modified_base 1: mod_base = um
  modified_base 2: mod_base = gm
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
tggaagcgatgacaaaaaaga

SEQ ID NO: 616 - RNA, 21 nt, synthetic construct
  modified_base 1: mod_base = OTHER; note = 2'-O-methyladenosine
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
accaggattccagcaaaaaca

SEQ ID NO: 617 - RNA, 21 nt, synthetic construct
  modified_base 1: mod_base = um
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
tctggtgaacctccaaaatca

SEQ ID NO: 618 - RNA, 21 nt, synthetic construct
  modified_base 1: mod_base = gm
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = cm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = OTHER; note = 2 -O-methylinosine
  modified_base 20: mod_base = gm
  modified_base 21: mod_base = OTHER; note = 2'-O-methyladenosine
  source 1..21: mol_type = other RNA
ggtgaacctccaaaatcanga

SEQ ID NO: 619 - RNA, 21 nt, synthetic construct
  modified_base 1: mod_base = um
  modified_base 2: mod_base = cm
  modified_base 3: mod_base = cm
  modified_base 4: mod_base = OTHER; note = 2'-O-methyl-2-aminoadenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2 -O-methylinosine
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
tccnaaatcaggggatcncaa

SEQ ID NO: 620 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyl-2-aminoadenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = cm
  modified_base 17: mod_base = cm
  modified_base 18: mod_base = OTHER; note = 2'-O-methyladenosine
  modified_base 19: mod_base = gm
  modified_base 20: mod_base = um
  modified_base 21: mod_base = um
  source 1..21: mol_type = other RNA
canatagtctacaaaccagtt

SEQ ID NO: 621 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyl-2-aminoadenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = cm
  modified_base 17: mod_base = um
  modified_base 18: mod_base = OTHER; note = 2'-O-methyladenosine
  modified_base 19: mod_base = gm
  modified_base 20: mod_base = um
  modified_base 21: mod_base = um
  source 1..21: mol_type = other RNA
canatagtctacaaactagtt

SEQ ID NO: 622 - RNA, 21 nt, synthetic construct
  modified_base 1: mod_base = OTHER; note = 2'-O-methyl-2-aminoadenosine
  modified_base 2: mod_base = OTHER; note = 2'-O-methyladenosine
  modified_base 3: mod_base = um
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = OTHER; note = 2'-O-methyladenosine
  modified_base 14: mod_base = cm
  modified_base 15: mod_base = cm
  modified_base 16: mod_base = OTHER; note = 2'-O-methyladenosine
  modified_base 17: mod_base = OTHER; note = 2 -O-methylinosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
natagtctacaaaccanttga

SEQ ID NO: 623 - RNA, 21 nt, synthetic construct
  modified_base 1: mod_base = OTHER; note = 2'-O-methyl-2-aminoadenosine
  modified_base 2: mod_base = um
  modified_base 3: mod_base = OTHER; note = 2'-O-methyladenosine
  modified_base 4: mod_base = gm
  modified_base 5: mod_base = um
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
ntagtctacaaaccagttgaa

SEQ ID NO: 624 - RNA, 21 nt, synthetic construct
  modified_base 1: mod_base = OTHER; note = 2'-O-methyladenosine
  modified_base 2: mod_base = gm
  modified_base 3: mod_base = um
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = OTHER; note = 2 -O-methylinosine
  modified_base 18: mod_base = OTHER; note = 2'-O-methyladenosine
  modified_base 19: mod_base = cm
  modified_base 20: mod_base = cm
  modified_base 21: mod_base = um
  source 1..21: mol_type = other RNA
agtctacaaaccagttnacct

SEQ ID NO: 625 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = gm
  modified_base 15: mod_base = OTHER; note = 2'-O-methyladenosine
  modified_base 16: mod_base = OTHER; note = 2 -O-methylinosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
aaccagttgacctgancaaga

SEQ ID NO: 626 - RNA, 21 nt, synthetic construct
  modified_base 1: mod_base = OTHER; note = 2'-O-methyladenosine
  modified_base 2: mod_base = cm
  modified_base 3: mod_base = cm
  modified_base 4: mod_base = um
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = gm
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine
  source 1..21: mol_type = other RNA
acctccaagtgtggctcatta

SEQ ID NO: 627 - RNA, 21 nt, synthetic construct
  modified_base 1: mod_base = cm
  modified_base 2: mod_base = um
  modified_base 3: mod_base = cm
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = gm
  modified_base 13: mod_base = cm
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
ctccaagtgtggctcattaga

SEQ ID NO: 628 - RNA, 21 nt, synthetic construct
  modified_base 1: mod_base = um
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = um
  modified_base 17: mod_base = um
  modified_base 18: mod_base = OTHER; note = 2'-O-methyladenosine
  modified_base 19: mod_base = gm
  modified_base 20: mod_base = gm
  modified_base 21: mod_base = OTHER; note = 2'-O-methyladenosine
  source 1..21: mol_type = other RNA
tccaagtgtggctcattagga

SEQ ID NO: 629 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = um
  modified_base 17: mod_base = OTHER; note = 2'-O-methyladenosine
  modified_base 18: mod_base = gm
  modified_base 19: mod_base = OTHER; note = 2 -O-methylinosine
  modified_base 20: mod_base = cm
  modified_base 21: mod_base = OTHER; note = 2'-O-methyladenosine
  source 1..21: mol_type = other RNA
ccaagtgtggctcattagnca

SEQ ID NO: 630 - RNA, 21 nt, synthetic construct
  modified_base 1: mod_base = gm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = gm
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gtggctcattaggcaacatca

SEQ ID NO: 631 - RNA, 21 nt, synthetic construct
  modified_base 1: mod_base = OTHER; note = 2'-O-methyl-2-aminoadenosine
  modified_base 2: mod_base = um
  modified_base 3: mod_base = um
  modified_base 4: mod_base = OTHER; note = 2'-O-methyladenosine
  modified_base 5: mod_base = gm
  modified_base 6: mod_base = gm
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine
  source 1..21: mol_type = other RNA
nttaggcaacatccatcataa

SEQ ID NO: 632 - RNA, 21 nt, synthetic construct
  modified_base 1: mod_base = gm
  modified_base 2: mod_base = um
  modified_base 3: mod_base = OTHER; note = 2'-O-methyladenosine
  modified_base 4: mod_base = gm
  modified_base 5: mod_base = gm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = cm
  modified_base 13: mod_base = cm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtaggcaacatccatcataaa

SEQ ID NO: 633 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
aggcaacatccatcataaaca

SEQ ID NO: 634 - RNA, 21 nt, synthetic construct
  modified_base 1: mod_base = gm
  modified_base 2: mod_base = gm
  modified_base 3: mod_base = cm
  modified_base 4: mod_base = cm
  modified_base 5: mod_base = OTHER; note = 2'-O-methyladenosine
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = um
  source 1..21: mol_type = other RNA
ggccaggtggaagtaaaatct

SEQ ID NO: 635 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = cm
  modified_base 14: mod_base = cm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2 -O-methylinosine
  modified_base 20: mod_base = cm
  modified_base 21: mod_base = um
  source 1..21: mol_type = other RNA
gnagattgaaacccacaanct

SEQ ID NO: 636 - RNA, 21 nt, synthetic construct
  modified_base 1: mod_base = OTHER; note = 2'-O-methyl-2-aminoadenosine
  modified_base 2: mod_base = gm
  modified_base 3: mod_base = OTHER; note = 2'-O-methyladenosine
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2 -O-methylinosine
  modified_base 18: mod_base = cm
  modified_base 19: mod_base = um
  modified_base 20: mod_base = gm
  modified_base 21: mod_base = OTHER; note = 2'-O-methyladenosine
  source 1..21: mol_type = other RNA
ngattgaaacccacaanctga

SEQ ID NO: 637 - RNA, 21 nt, synthetic construct
  modified_base 1: mod_base = gm
  modified_base 2: mod_base = OTHER; note = 2'-O-methyl-2-aminoadenosine
  modified_base 3: mod_base = um
  modified_base 4: mod_base = um
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2 -O-methylinosine
  modified_base 17: mod_base = cm
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gnttgaaacccacaanctgaa

SEQ ID NO: 638 - DNA, 21 bp, synthetic construct
  modified_base 1: mod_base = OTHER; note = 2'-O-methyladenosine
  modified_base 2: mod_base = cm
  modified_base 3: mod_base = gm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2 -O-methylinosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other DNA
acgccaaagccaagacanaca

SEQ ID NO: 639 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 640 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 641 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 642 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = OTHER; note = 2'-fluorocytidine
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 643 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
cagcatcgacatggtagacta

SEQ ID NO: 644 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-deoxythymidine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
  modified_base 12: mod_base = OTHER; note = thymine
cagcatcgacatggtagacta

SEQ ID NO: 645 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = um
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgatatggtagacta

SEQ ID NO: 646 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 647 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 648 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 649 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = OTHER; note = 2'-O-hexadecanyluridine
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 650 - RNA, 21 nt, synthetic construct
  modified_base 1: mod_base = gm
  modified_base 1^2: mod_base = OTHER; note = phosphorothioate linkage
  modified_base 2: mod_base = um
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-hexadecanylcytidine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = cm
  modified_base 14: mod_base = gm
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 19^20: mod_base = OTHER; note = phosphorothioate linkage
  modified_base 20: mod_base = um
  modified_base 20^21: mod_base = OTHER; note = phosphorothioate linkage
  modified_base 21: mod_base = OTHER; note = 2'-O-methyladenosine
  source 1..21: mol_type = other RNA
gtgacccaagctcgtatggta

SEQ ID NO: 651 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = OTHER; note = 2'-fluoroguanosine
  modified_base 8: mod_base = um
  modified_base 9: mod_base = OTHER; note = 2'-fluoroguanosine
  modified_base 10: mod_base = gm
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = um
  modified_base 17: mod_base = OTHER; note = 2'-O-methyladenosine
  modified_base 18: mod_base = gm
  modified_base 19: mod_base = gm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ccaagtgtggctcattaggta

SEQ ID NO: 652 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcaacatggtagacta

SEQ ID NO: 653 - RNA, 21 nt, synthetic construct
  modified_base 1: mod_base = OTHER; note = inverted (3'-3' linked) abasic deoxyribonucleotide-phosphorothioate-2'-O-methyluridine
  modified_base 2: mod_base = cm
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = gm
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tcgcatggtcagtaaaagcaa

SEQ ID NO: 654 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 655 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 656 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = gm
  modified_base 16: mod_base = OTHER; note = 2'-O-methyladenosine
  modified_base 17: mod_base = cm
  modified_base 18: mod_base = OTHER; note = 2 -O-methylinosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gaagatcacgctgggacntaa

SEQ ID NO: 657 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gaagatcacgctgggatgtaa

SEQ ID NO: 658 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = cm
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = cm
  modified_base 15: mod_base = um
  modified_base 16: mod_base = OTHER; note = 2 -O-methylinosine
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gaagacgaagctgctngtcaa

SEQ ID NO: 659 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = cm
  modified_base 7: mod_base = um
  modified_base 8: mod_base = cm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
ccaagctcgcatggtcagtaa

SEQ ID NO: 660 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = gm
  modified_base 3: mod_base = cm
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
cgcatggtcagtaaaagcaaa

SEQ ID NO: 661 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = gm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroadenosine
  modified_base 12: mod_base = gm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = OTHER; note = 2 -O-methylinosine
  modified_base 21: mod_base = OTHER; note = 2'-O-methyladenosine-phosphorothioate-inverted (3'-3' linked) abasic deoxyribonucleotide
  source 1..21: mol_type = other RNA
ggtcagtaaaagcaaagacna

SEQ ID NO: 662 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gactggaagcgatgacaaaaa

SEQ ID NO: 663 - RNA, 21 nt, synthetic construct
  modified_base 1: mod_base = OTHER; note = inverted (3'-3' linked) abasic deoxyribonucleotide-phosphorothioate-2'-O-methyluridine
  modified_base 2: mod_base = gm
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
tggaagcgatgacaaaaaaga

SEQ ID NO: 664 - RNA, 21 nt, synthetic construct
  modified_base 1: mod_base = OTHER; note = inverted (3'-3' linked) abasic deoxyribonucleotide-phosphorothioate-2'-O-methyladenosine
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
accaggattccagcaaaaaca

SEQ ID NO: 665 - RNA, 21 nt, synthetic construct
  modified_base 1: mod_base = OTHER; note = inverted (3'-3' linked) abasic deoxyribonucleotide-phosphorothioate-2'-O-methyluridine
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
tctggtgaacctccaaaatca

SEQ ID NO: 666 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = cm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = OTHER; note = 2 -O-methylinosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ggtgaacctccaaaatcanga

SEQ ID NO: 667 - RNA, 21 nt, synthetic construct
  modified_base 1: mod_base = OTHER; note = inverted (3'-3' linked) abasic deoxyribonucleotide-phosphorothioate-2'-O-methyluridine
  modified_base 2: mod_base = cm
  modified_base 3: mod_base = cm
  modified_base 4: mod_base = OTHER; note = 2'-O-methyl-2-aminoadenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2 -O-methylinosine
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tccnaaatcaggggatcncaa

SEQ ID NO: 668 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = OTHER; note = 2'-O-methyl-2-aminoadenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = cm
  modified_base 17: mod_base = cm
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyluridine-phosphorothioate-inverted (3'-3' linked) abasic deoxyribonucleotide
  source 1..21: mol_type = other RNA
canatagtctacaaaccagtt

SEQ ID NO: 669 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = OTHER; note = 2'-O-methyl-2-aminoadenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = cm
  modified_base 17: mod_base = um
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyluridine-phosphorothioate-inverted (3'-3' linked) abasic deoxyribonucleotide
  source 1..21: mol_type = other RNA
canatagtctacaaactagtt

SEQ ID NO: 670 - RNA, 21 nt, synthetic construct
  modified_base 1: mod_base = OTHER; note = inverted (3'-3' linked) abasic deoxyribonucleotide-phosphorothioate-2'-O-methyl-2-aminoade nosine
  modified_base 2: mod_base = OTHER; note = 2'-O-methyladenosine
  modified_base 3: mod_base = um
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = OTHER; note = 2'-O-methyladenosine
  modified_base 14: mod_base = cm
  modified_base 15: mod_base = cm
  modified_base 16: mod_base = OTHER; note = 2'-O-methyladenosine
  modified_base 17: mod_base = OTHER; note = 2 -O-methylinosine
  modified_base 18: mod_base = um
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
natagtctacaaaccanttga

SEQ ID NO: 671 - RNA, 21 nt, synthetic construct
  modified_base 1: mod_base = OTHER; note = inverted (3'-3' linked) abasic deoxyribonucleotide-phosphorothioate-2'-O-methyl-2-aminoade nosine
  modified_base 2: mod_base = um
  modified_base 3: mod_base = OTHER; note = 2'-O-methyladenosine
  modified_base 4: mod_base = gm
  modified_base 5: mod_base = um
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
ntagtctacaaaccagttgaa

SEQ ID NO: 672 - RNA, 21 nt, synthetic construct
  modified_base 1: mod_base = OTHER; note = inverted (3'-3' linked) abasic deoxyribonucleotide-phosphorothioate-2'-O-methyladenosine
  modified_base 2: mod_base = gm
  modified_base 3: mod_base = um
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = OTHER; note = 2 -O-methylinosine
  modified_base 18: mod_base = OTHER; note = 2'-O-methyladenosine
  modified_base 19: mod_base = cm
  modified_base 20: mod_base = cm
  modified_base 21: mod_base = OTHER; note = 2'-O-methyluridine-phosphorothioate-inverted (3'-3' linked) abasic deoxyribonucleotide
  source 1..21: mol_type = other RNA
agtctacaaaccagttnacct

SEQ ID NO: 673 - RNA, 21 nt, synthetic construct
  modified_base 1: mod_base = OTHER; note = inverted (3'-3' linked) abasic deoxyribonucleotide-phosphorothioate-2'-O-methyladenosine
  modified_base 2: mod_base = OTHER; note = 2'-O-methyladenosine
  modified_base 3: mod_base = cm
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = gm
  modified_base 15: mod_base = OTHER; note = 2'-O-methyladenosine
  modified_base 16: mod_base = OTHER; note = 2 -O-methylinosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
aaccagttgacctgancaaga

SEQ ID NO: 674 - RNA, 21 nt, synthetic construct
  modified_base 1: mod_base = OTHER; note = inverted (3'-3' linked) abasic deoxyribonucleotide-phosphorothioate-2'-O-methyladenosine
  modified_base 2: mod_base = cm
  modified_base 3: mod_base = cm
  modified_base 4: mod_base = um
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = gm
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
acctccaagtgtggctcatta

SEQ ID NO: 675 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = um
  modified_base 3: mod_base = cm
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = gm
  modified_base 13: mod_base = cm
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ctccaagtgtggctcattaga

SEQ ID NO: 676 - RNA, 21 nt, synthetic construct
  modified_base 1: mod_base = OTHER; note = inverted (3'-3' linked) abasic deoxyribonucleotide-phosphorothioate-2'-O-methyluridine
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = um
  modified_base 17: mod_base = um
  modified_base 18: mod_base = OTHER; note = 2'-O-methyladenosine
  modified_base 19: mod_base = gm
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
tccaagtgtggctcattagga

SEQ ID NO: 677 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = um
  modified_base 17: mod_base = OTHER; note = 2'-O-methyladenosine
  modified_base 18: mod_base = gm
  modified_base 19: mod_base = OTHER; note = 2 -O-methylinosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ccaagtgtggctcattagnca

SEQ ID NO: 678 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = gm
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
gtggctcattaggcaacatca

SEQ ID NO: 679 - RNA, 21 nt, synthetic construct
  modified_base 1: mod_base = OTHER; note = inverted (3'-3' linked) abasic deoxyribonucleotide-phosphorothioate-2'-O-methyl-2-aminoade nosine
  modified_base 2: mod_base = um
  modified_base 3: mod_base = um
  modified_base 4: mod_base = OTHER; note = 2'-O-methyladenosine
  modified_base 5: mod_base = gm
  modified_base 6: mod_base = gm
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
nttaggcaacatccatcataa

SEQ ID NO: 680 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = um
  modified_base 3: mod_base = OTHER; note = 2'-O-methyladenosine
  modified_base 4: mod_base = gm
  modified_base 5: mod_base = gm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = cm
  modified_base 13: mod_base = cm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gtaggcaacatccatcataaa

SEQ ID NO: 681 - RNA, 21 nt, synthetic construct
  modified_base 1: mod_base = OTHER; note = inverted (3'-3' linked) abasic deoxyribonucleotide-phosphorothioate-2'-O-methyladenosine
  modified_base 2: mod_base = gm
  modified_base 3: mod_base = gm
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
aggcaacatccatcataaaca

SEQ ID NO: 682 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = gm
  modified_base 3: mod_base = cm
  modified_base 4: mod_base = cm
  modified_base 5: mod_base = OTHER; note = 2'-O-methyladenosine
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyluridine-phosphorothioate-inverted (3'-3' linked) abasic deoxyribonucleotide
  source 1..21: mol_type = other RNA
ggccaggtggaagtaaaatct

SEQ ID NO: 683 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = OTHER; note = 2'-O-methyl-2-aminoadenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = cm
  modified_base 14: mod_base = cm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2 -O-methylinosine
  modified_base 20: mod_base = cm
  modified_base 21: mod_base = OTHER; note = 2'-O-methyluridine-phosphorothioate-inverted (3'-3' linked) abasic deoxyribonucleotide
  source 1..21: mol_type = other RNA
gnagattgaaacccacaanct

SEQ ID NO: 684 - RNA, 21 nt, synthetic construct
  modified_base 1: mod_base = OTHER; note = inverted (3'-3' linked) abasic deoxyribonucleotide-phosphorothioate-2'-O-methyl-2-aminoade nosine
  modified_base 2: mod_base = gm
  modified_base 3: mod_base = OTHER; note = 2'-O-methyladenosine
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2 -O-methylinosine
  modified_base 18: mod_base = cm
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ngattgaaacccacaanctga

SEQ ID NO: 685 - RNA, 21 nt, synthetic construct
  modified_base 1: mod_base = OTHER; note = inverted (3'-3' linked) abasic deoxyribonucleotide-phosphorothioate-2'-O-methylguanosine
  modified_base 2: mod_base = OTHER; note = 2'-O-methyl-2-aminoadenosine
  modified_base 3: mod_base = um
  modified_base 4: mod_base = um
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2 -O-methylinosine
  modified_base 17: mod_base = cm
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gnttgaaacccacaanctgaa

SEQ ID NO: 686 - DNA, 21 bp, synthetic construct
  modified_base 1: mod_base = OTHER; note = inverted (3'-3' linked) abasic deoxyribonucleotide-phosphorothioate-2'-O-methyladenosine
  modified_base 2: mod_base = cm
  modified_base 3: mod_base = gm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2 -O-methylinosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other DNA
acgccaaagccaagacanaca

SEQ ID NO: 687 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 688 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 689 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 690 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = OTHER; note = 2'-fluorocytidine
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 691 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 692 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-deoxythymidine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
  modified_base 12: mod_base = OTHER; note = thymine
cagcatcgacatggtagacta

SEQ ID NO: 693 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = um
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgatatggtagacta

SEQ ID NO: 694 - RNA, 21 nt, synthetic construct
  modified_base 1: mod_base = OTHER; note 5'-6-(3-(2-hexyldecanamido)bicyclo[1.1.1]pentane-1-carboxam ido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 695 - RNA, 21 nt, synthetic construct
  modified_base 1: mod_base = OTHER; note = 5'-6-(3-(16-hydroxyhexadecyl)ureido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 696 - RNA, 21 nt, synthetic construct
  modified_base 1: mod_base = OTHER; note 5'-6-(3-(15-(((2R,3R,4S,5S,6R)-3,4,5-trihydroxy-6-(hydroxym ethyl)tetrahydro-2H-pyran-2-yl)oxy)pentadecyl)ureido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 697 - RNA, 21 nt, synthetic construct
  modified_base 1: mod_base = OTHER; note = inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = OTHER; note = 2'-O-hexadecanyluridine
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 698 - RNA, 21 nt, synthetic construct
  modified_base 1: mod_base = gm
  modified_base 1^2: mod_base = OTHER; note = phosphorothioate linkage
  modified_base 2: mod_base = um
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-hexadecanylcytidine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = cm
  modified_base 14: mod_base = gm
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 19^20: mod_base = OTHER; note = phosphorothioate linkage
  modified_base 20: mod_base = um
  modified_base 20^21: mod_base = OTHER; note = phosphorothioate linkage
  modified_base 21: mod_base = OTHER; note = 2'-O-methyladenosine
  source 1..21: mol_type = other RNA
gtgacccaagctcgtatggta

SEQ ID NO: 699 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methylcytidine
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = OTHER; note = 2'-fluoroguanosine
  modified_base 8: mod_base = um
  modified_base 9: mod_base = OTHER; note = 2'-fluoroguanosine
  modified_base 10: mod_base = gm
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = um
  modified_base 17: mod_base = OTHER; note = 2'-O-methyladenosine
  modified_base 18: mod_base = gm
  modified_base 19: mod_base = gm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ccaagtgtggctcattaggta

SEQ ID NO: 700 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcaacatggtagacta

SEQ ID NO: 701 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methyluridine
  modified_base 2: mod_base = cm
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = gm
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = gm
  modified_base 13: mod_base = um
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tcgcatggtcagtaaaagcaa

SEQ ID NO: 702 - RNA, 21 nt, synthetic construct
  modified_base 1: mod_base = OTHER; note = 5'-6-aminohexyl phosphorothioate-L20-Fab0070-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 703 - RNA, 21 nt, synthetic construct
  modified_base 1: mod_base = OTHER; note = 5'-6-aminohexyl phosphorothioate-L-1026-Fab0070-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 704 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = gm
  modified_base 16: mod_base = OTHER; note = 2'-O-methyladenosine
  modified_base 17: mod_base = cm
  modified_base 18: mod_base = OTHER; note = 2 -O-methylinosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gaagatcacgctgggacntaa

SEQ ID NO: 705 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = gm
  modified_base 16: mod_base = OTHER; note = 2'-O-methyladenosine
  modified_base 17: mod_base = um
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gaagatcacgctgggatgtaa

SEQ ID NO: 706 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = cm
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = cm
  modified_base 15: mod_base = um
  modified_base 16: mod_base = OTHER; note = 2 -O-methylinosine
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gaagacgaagctgctngtcaa

SEQ ID NO: 707 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylcytidine
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = cm
  modified_base 7: mod_base = um
  modified_base 8: mod_base = cm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = gm
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
ccaagctcgcatggtcagtaa

SEQ ID NO: 708 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylcytidine
  modified_base 2: mod_base = gm
  modified_base 3: mod_base = cm
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
cgcatggtcagtaaaagcaaa

SEQ ID NO: 709 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = gm
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroadenosine
  modified_base 12: mod_base = gm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = OTHER; note = 2 -O-methylinosine
  modified_base 21: mod_base = OTHER; note = 2'-O-methyladenosine-phosphorothioate-inverted (3'-3' linked) abasic deoxyribonucleotide
  source 1..21: mol_type = other RNA
ggtcagtaaaagcaaagacna

SEQ ID NO: 710 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gactggaagcgatgacaaaaa

SEQ ID NO: 711 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyluridine
  modified_base 2: mod_base = gm
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
tggaagcgatgacaaaaaaga

SEQ ID NO: 712 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyladenosine
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
accaggattccagcaaaaaca

SEQ ID NO: 713 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyluridine
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
tctggtgaacctccaaaatca

SEQ ID NO: 714 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = cm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = OTHER; note = 2 -O-methylinosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ggtgaacctccaaaatcanga

SEQ ID NO: 715 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyluridine
  modified_base 2: mod_base = cm
  modified_base 3: mod_base = cm
  modified_base 4: mod_base = OTHER; note = 2'-O-methyl-2-aminoadenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2 -O-methylinosine
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tccnaaatcaggggatcncaa

SEQ ID NO: 716 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = OTHER; note = 2'-O-methyl-2-aminoadenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = cm
  modified_base 17: mod_base = cm
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyluridine-phosphorothioate-inverted (3'-3' linked) abasic deoxyribonucleotide
  source 1..21: mol_type = other RNA
canatagtctacaaaccagtt

SEQ ID NO: 717 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = OTHER; note = 2'-O-methyl-2-aminoadenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = OTHER; note = 2'-O-methyladenosine
  modified_base 15: mod_base = OTHER; note = 2'-O-methyladenosine
  modified_base 16: mod_base = cm
  modified_base 17: mod_base = um
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyluridine-phosphorothioate-inverted (3'-3' linked) abasic deoxyribonucleotide
  source 1..21: mol_type = other RNA
canatagtctacaaactagtt

SEQ ID NO: 718 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyl-2-aminoade nosine
  modified_base 2: mod_base = OTHER; note = 2'-O-methyladenosine
  modified_base 3: mod_base = um
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = OTHER; note = 2'-O-methyladenosine
  modified_base 14: mod_base = cm
  modified_base 15: mod_base = cm
  modified_base 16: mod_base = OTHER; note = 2'-O-methyladenosine
  modified_base 17: mod_base = OTHER; note = 2 -O-methylinosine
  modified_base 18: mod_base = um
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
natagtctacaaaccanttga

SEQ ID NO: 719 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyl-2-aminoade nosine
  modified_base 2: mod_base = um
  modified_base 3: mod_base = OTHER; note = 2'-O-methyladenosine
  modified_base 4: mod_base = gm
  modified_base 5: mod_base = um
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = gm
  modified_base 17: mod_base = um
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
ntagtctacaaaccagttgaa

SEQ ID NO: 720 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyladenosine
  modified_base 2: mod_base = gm
  modified_base 3: mod_base = um
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = OTHER; note = 2 -O-methylinosine
  modified_base 18: mod_base = OTHER; note = 2'-O-methyladenosine
  modified_base 19: mod_base = cm
  modified_base 20: mod_base = cm
  modified_base 21: mod_base = OTHER; note = 2'-O-methyluridine-phosphorothioate-inverted (3'-3' linked) abasic deoxyribonucleotide
  source 1..21: mol_type = other RNA
agtctacaaaccagttnacct

SEQ ID NO: 721 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyladenosine
  modified_base 2: mod_base = OTHER; note = 2'-O-methyladenosine
  modified_base 3: mod_base = cm
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = gm
  modified_base 15: mod_base = OTHER; note = 2'-O-methyladenosine
  modified_base 16: mod_base = OTHER; note = 2 -O-methylinosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
aaccagttgacctgancaaga

SEQ ID NO: 722 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyladenosine
  modified_base 2: mod_base = cm
  modified_base 3: mod_base = cm
  modified_base 4: mod_base = um
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = gm
  modified_base 15: mod_base = cm
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
acctccaagtgtggctcatta

SEQ ID NO: 723 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylcytidine
  modified_base 2: mod_base = um
  modified_base 3: mod_base = cm
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = gm
  modified_base 13: mod_base = cm
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ctccaagtgtggctcattaga

SEQ ID NO: 724 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyluridine
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = um
  modified_base 17: mod_base = um
  modified_base 18: mod_base = OTHER; note = 2'-O-methyladenosine
  modified_base 19: mod_base = gm
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
tccaagtgtggctcattagga

SEQ ID NO: 725 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylcytidine
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = um
  modified_base 17: mod_base = OTHER; note = 2'-O-methyladenosine
  modified_base 18: mod_base = gm
  modified_base 19: mod_base = OTHER; note = 2 -O-methylinosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ccaagtgtggctcattagnca

SEQ ID NO: 726 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = gm
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
gtggctcattaggcaacatca

SEQ ID NO: 727 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyl-2-aminoade nosine
  modified_base 2: mod_base = um
  modified_base 3: mod_base = um
  modified_base 4: mod_base = OTHER; note = 2'-O-methyladenosine
  modified_base 5: mod_base = gm
  modified_base 6: mod_base = gm
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
nttaggcaacatccatcataa

SEQ ID NO: 728 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = um
  modified_base 3: mod_base = OTHER; note = 2'-O-methyladenosine
  modified_base 4: mod_base = gm
  modified_base 5: mod_base = gm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorouridine
  modified_base 12: mod_base = cm
  modified_base 13: mod_base = cm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gtaggcaacatccatcataaa

SEQ ID NO: 729 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyladenosine
  modified_base 2: mod_base = gm
  modified_base 3: mod_base = gm
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
aggcaacatccatcataaaca

SEQ ID NO: 730 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = gm
  modified_base 3: mod_base = cm
  modified_base 4: mod_base = cm
  modified_base 5: mod_base = OTHER; note = 2'-O-methyladenosine
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyluridine-phosphorothioate-inverted (3'-3' linked) abasic deoxyribonucleotide
  source 1..21: mol_type = other RNA
ggccaggtggaagtaaaatct

SEQ ID NO: 731 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = OTHER; note = 2'-O-methyl-2-aminoadenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = cm
  modified_base 14: mod_base = cm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2 -O-methylinosine
  modified_base 20: mod_base = cm
  modified_base 21: mod_base = OTHER; note = 2'-O-methyluridine-phosphorothioate-inverted (3'-3' linked) abasic deoxyribonucleotide
  source 1..21: mol_type = other RNA
gnagattgaaacccacaanct

SEQ ID NO: 732 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyl-2-aminoade nosine
  modified_base 2: mod_base = gm
  modified_base 3: mod_base = OTHER; note = 2'-O-methyladenosine
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = OTHER; note = 2 -O-methylinosine
  modified_base 18: mod_base = cm
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ngattgaaacccacaanctga

SEQ ID NO: 733 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylguanosine
  modified_base 2: mod_base = OTHER; note = 2'-O-methyl-2-aminoadenosine
  modified_base 3: mod_base = um
  modified_base 4: mod_base = um
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2 -O-methylinosine
  modified_base 17: mod_base = cm
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gnttgaaacccacaanctgaa

SEQ ID NO: 734 - DNA, 21 bp, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methyladenosine
  modified_base 2: mod_base = cm
  modified_base 3: mod_base = gm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2 -O-methylinosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other DNA
acgccaaagccaagacanaca

SEQ ID NO: 735 - RNA, 21 nt, synthetic construct
  modified_base 1: mod_base = OTHER; note = 5'-6-palmitamidohexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 736 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 737 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 738 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = OTHER; note = 2'-fluorocytidine
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 739 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-fluorouridine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cagcatcgacatggtagacta

SEQ ID NO: 740 - RNA, 21 nt, synthetic construct
  modified_base 1: mod_base = OTHER; note = 5'-6-(16-hydroxyhexadecanamido)hexyl phosphorothioate-inverted (3'-3' linked) abasic deoxyribonucleotide-phosphorothioate-2'-O-methylcytidine
  modified_base 2: mod_base = OTHER; note = 2'-O-methyladenosine
  modified_base 3: mod_base = gm
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = gm
  modified_base 9: mod_base = OTHER; note = 2'-fluoroadenosine
  modified_base 10: mod_base = cm
  modified_base 11: mod_base = OTHER; note = 2'-fluoroadenosine
  modified_base 12: mod_base = OTHER; note = 2'-deoxythymidine
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
  modified_base 12: mod_base = OTHER; note = thymine
cagcatcgacatggtagacta

SEQ ID NO: 741 - RNA, 21 nt, synthetic construct
  source 1..21: mol_type = other RNA
tagtctaccatgttgatgctg

SEQ ID NO: 742 - RNA, 21 nt, synthetic construct
  source 1..21: mol_type = other RNA
tagtctactatgtcgatgctg

SEQ ID NO: 743 - RNA, 21 nt, synthetic construct
  source 1..21: mol_type = other RNA
tagtctaccatgtcgatgctg

SEQ ID NO: 744 - RNA, 23 nt, synthetic construct
  source 1..23: mol_type = other RNA
taccatacgagcttgggtcacgt

SEQ ID NO: 745 - RNA, 21 nt, synthetic construct
  modified_base 14: mod_base = OTHER; note = thymine
  source 1..21: mol_type = other RNA
tagtctaccatgttgatgctg

SEQ ID NO: 746 - RNA, 21 nt, synthetic construct
  source 1..21: mol_type = other RNA
ttgcttttactgaccatgcga

SEQ ID NO: 747 - RNA, 21 nt, synthetic construct
  source 1..21: mol_type = other RNA
ttacgtcccagcgtgatcttc

SEQ ID NO: 748 - RNA, 21 nt, synthetic construct
  source 1..21: mol_type = other RNA
ttgaccagcagcttcgtcttc

SEQ ID NO: 749 - RNA, 21 nt, synthetic construct
  source 1..21: mol_type = other RNA
ttactgaccatgcgagcttgg

SEQ ID NO: 750 - RNA, 21 nt, synthetic construct
  source 1..21: mol_type = other RNA
tttgcttttactgaccatgcg

SEQ ID NO: 751 - RNA, 21 nt, synthetic construct
  source 1..21: mol_type = other RNA
tcgtctttgcttttactgacc

SEQ ID NO: 752 - RNA, 21 nt, synthetic construct
  source 1..21: mol_type = other RNA
tttttgtcatcgcttccagtc

SEQ ID NO: 753 - RNA, 21 nt, synthetic construct
  source 1..21: mol_type = other RNA
tcttttttgtcatcgcttcca

SEQ ID NO: 754 - RNA, 21 nt, synthetic construct
  source 1..21: mol_type = other RNA
tgtttttgctggaatcctggt

SEQ ID NO: 755 - RNA, 21 nt, synthetic construct
  source 1..21: mol_type = other RNA
tgattttggaggttcaccaga

SEQ ID NO: 756 - RNA, 21 nt, synthetic construct
  source 1..21: mol_type = other RNA
tcctgattttggaggttcacc

SEQ ID NO: 757 - RNA, 21 nt, synthetic construct
  source 1..21: mol_type = other RNA
ttgcgatcccctgattttgga

SEQ ID NO: 758 - RNA, 21 nt, synthetic construct
  source 1..21: mol_type = other RNA
aactggtttgtagactatttg

SEQ ID NO: 759 - RNA, 21 nt, synthetic construct
  source 1..21: mol_type = other RNA
tcaactggtttgtagactatt

SEQ ID NO: 760 - RNA, 21 nt, synthetic construct
  source 1..21: mol_type = other RNA
ttcaactggtttgtagactat

SEQ ID NO: 761 - RNA, 21 nt, synthetic construct
  source 1..21: mol_type = other RNA
aggtcaactggtttgtagact

SEQ ID NO: 762 - RNA, 21 nt, synthetic construct
  source 1..21: mol_type = other RNA
tcttgctcaggtcaactggtt

SEQ ID NO: 763 - RNA, 21 nt, synthetic construct
  source 1..21: mol_type = other RNA
taatgagccacacttggaggt

SEQ ID NO: 764 - RNA, 21 nt, synthetic construct
  source 1..21: mol_type = other RNA
tctaatgagccacacttggag

SEQ ID NO: 765 - RNA, 21 nt, synthetic construct
  source 1..21: mol_type = other RNA
tcctaatgagccacacttgga

SEQ ID NO: 766 - RNA, 21 nt, synthetic construct
  source 1..21: mol_type = other RNA
tgcctaatgagccacacttgg

SEQ ID NO: 767 - RNA, 21 nt, synthetic construct
  source 1..21: mol_type = other RNA
tgatgttgcctaatgagccac

SEQ ID NO: 768 - RNA, 21 nt, synthetic construct
  source 1..21: mol_type = other RNA
ttatgatggatgttgcctaat

SEQ ID NO: 769 - RNA, 21 nt, synthetic construct
  source 1..21: mol_type = other RNA
tttatgatggatgttgcctac

SEQ ID NO: 770 - RNA, 21 nt, synthetic construct
  source 1..21: mol_type = other RNA
tgtttatgatggatgttgcct

SEQ ID NO: 771 - RNA, 21 nt, synthetic construct
  source 1..21: mol_type = other RNA
agattttacttccacctggcc

SEQ ID NO: 772 - RNA, 21 nt, synthetic construct
  source 1..21: mol_type = other RNA
agcttgtgggtttcaatcttc

SEQ ID NO: 773 - RNA, 21 nt, synthetic construct
  source 1..21: mol_type = other RNA
tcagcttgtgggtttcaatct

SEQ ID NO: 774 - RNA, 21 nt, synthetic construct
  source 1..21: mol_type = other RNA
ttcagcttgtgggtttcaatc

SEQ ID NO: 775 - RNA, 21 nt, synthetic construct
  source 1..21: mol_type = other RNA
tgtctgtcttggctttggcgt

SEQ ID NO: 776 - RNA, 21 nt, synthetic construct
  source 1..21: mol_type = other RNA
cagcatcgatatggtagacta

SEQ ID NO: 777 - RNA, 21 nt, synthetic construct
  source 1..21: mol_type = other RNA
cagcatcgacatggtagacta

SEQ ID NO: 778 - RNA, 21 nt, synthetic construct
  source 1..21: mol_type = other RNA
gtgacccaagctcgtatggta

SEQ ID NO: 779 - RNA, 21 nt, synthetic construct
  source 1..21: mol_type = other RNA
ccaagtgtggctcattaggta

SEQ ID NO: 780 - RNA, 21 nt, synthetic construct
  source 1..21: mol_type = other RNA
cagcatcaacatggtagacta

SEQ ID NO: 781 - RNA, 21 nt, synthetic construct
  source 1..21: mol_type = other RNA
tcgcatggtcagtaaaagcaa

SEQ ID NO: 782 - RNA, 21 nt, synthetic construct
  modified_base 18: mod_base = i
  source 1..21: mol_type = other RNA
gaagatcacgctgggacntaa

SEQ ID NO: 783 - RNA, 21 nt, synthetic construct
  source 1..21: mol_type = other RNA
gaagatcacgctgggatgtaa

SEQ ID NO: 784 - RNA, 21 nt, synthetic construct
  modified_base 16: mod_base = i
  source 1..21: mol_type = other RNA
gaagacgaagctgctngtcaa

SEQ ID NO: 785 - RNA, 21 nt, synthetic construct
  source 1..21: mol_type = other RNA
ccaagctcgcatggtcagtaa

SEQ ID NO: 786 - RNA, 21 nt, synthetic construct
  source 1..21: mol_type = other RNA
cgcatggtcagtaaaagcaaa

SEQ ID NO: 787 - RNA, 21 nt, synthetic construct
  modified_base 20: mod_base = i
  source 1..21: mol_type = other RNA
ggtcagtaaaagcaaagacna

SEQ ID NO: 788 - RNA, 21 nt, synthetic construct
  source 1..21: mol_type = other RNA
gactggaagcgatgacaaaaa

SEQ ID NO: 789 - RNA, 21 nt, synthetic construct
  source 1..21: mol_type = other RNA
tggaagcgatgacaaaaaaga

SEQ ID NO: 790 - RNA, 21 nt, synthetic construct
  source 1..21: mol_type = other RNA
accaggattccagcaaaaaca

SEQ ID NO: 791 - RNA, 21 nt, synthetic construct
  source 1..21: mol_type = other RNA
tctggtgaacctccaaaatca

SEQ ID NO: 792 - RNA, 21 nt, synthetic construct
  modified_base 19: mod_base = i
  source 1..21: mol_type = other RNA
ggtgaacctccaaaatcanga

SEQ ID NO: 793 - RNA, 21 nt, synthetic construct
  modified_base 4: mod_base = OTHER; note = 2-aminoadenine nucleotide
  modified_base 18: mod_base = i
  source 1..21: mol_type = other RNA
tccnaaatcaggggatcncaa

SEQ ID NO: 794 - RNA, 21 nt, synthetic construct
  modified_base 3: mod_base = OTHER; note = 2-aminoadenine nucleotide
  source 1..21: mol_type = other RNA
canatagtctacaaaccagtt

SEQ ID NO: 795 - RNA, 21 nt, synthetic construct
  modified_base 3: mod_base = OTHER; note = 2-aminoadenine nucleotide
  source 1..21: mol_type = other RNA
canatagtctacaaactagtt

SEQ ID NO: 796 - RNA, 21 nt, synthetic construct
  modified_base 1: mod_base = OTHER; note = 2-aminoadenine nucleotide
  modified_base 17: mod_base = i
  source 1..21: mol_type = other RNA
natagtctacaaaccanttga

SEQ ID NO: 797 - RNA, 21 nt, synthetic construct
  modified_base 1: mod_base = OTHER; note = 2-aminoadenine nucleotide
  source 1..21: mol_type = other RNA
ntagtctacaaaccagttgaa

SEQ ID NO: 798 - RNA, 21 nt, synthetic construct
  modified_base 17: mod_base = i
  source 1..21: mol_type = other RNA
agtctacaaaccagttnacct

SEQ ID NO: 799 - RNA, 21 nt, synthetic construct
  modified_base 16: mod_base = i
  source 1..21: mol_type = other RNA
aaccagttgacctgancaaga

SEQ ID NO: 800 - RNA, 21 nt, synthetic construct
  source 1..21: mol_type = other RNA
acctccaagtgtggctcatta

SEQ ID NO: 801 - RNA, 21 nt, synthetic construct
  source 1..21: mol_type = other RNA
ctccaagtgtggctcattaga

SEQ ID NO: 802 - RNA, 21 nt, synthetic construct
  source 1..21: mol_type = other RNA
tccaagtgtggctcattagga

SEQ ID NO: 803 - RNA, 21 nt, synthetic construct
  modified_base 19: mod_base = i
  source 1..21: mol_type = other RNA
ccaagtgtggctcattagnca

SEQ ID NO: 804 - RNA, 21 nt, synthetic construct
  source 1..21: mol_type = other RNA
gtggctcattaggcaacatca

SEQ ID NO: 805 - RNA, 21 nt, synthetic construct
  modified_base 1: mod_base = OTHER; note = 2-aminoadenine nucleotide
  source 1..21: mol_type = other RNA
nttaggcaacatccatcataa

SEQ ID NO: 806 - RNA, 21 nt, synthetic construct
  source 1..21: mol_type = other RNA
gtaggcaacatccatcataaa

SEQ ID NO: 807 - RNA, 21 nt, synthetic construct
  source 1..21: mol_type = other RNA
aggcaacatccatcataaaca

SEQ ID NO: 808 - RNA, 21 nt, synthetic construct
  source 1..21: mol_type = other RNA
ggccaggtggaagtaaaatct

SEQ ID NO: 809 - RNA, 21 nt, synthetic construct
  modified_base 2: mod_base = OTHER; note = 2-aminoadenine nucleotide
  modified_base 19: mod_base = i
  source 1..21: mol_type = other RNA
gnagattgaaacccacaanct

SEQ ID NO: 810 - RNA, 21 nt, synthetic construct
  modified_base 1: mod_base = OTHER; note = 2-aminoadenine nucleotide
  modified_base 17: mod_base = i
  source 1..21: mol_type = other RNA
ngattgaaacccacaanctga

SEQ ID NO: 811 - RNA, 21 nt, synthetic construct
  modified_base 2: mod_base = OTHER; note = 2-aminoadenine nucleotide
  modified_base 16: mod_base = i
  source 1..21: mol_type = other RNA
gnttgaaacccacaanctgaa

SEQ ID NO: 812 - DNA, 21 bp, synthetic construct
  modified_base 18: mod_base = i
  source 1..21: mol_type = other DNA
acgccaaagccaagacanaca

SEQ ID NO: 813 - RNA, 21 nt, synthetic construct
  source 1..21: mol_type = other RNA
  modified_base 12: mod_base = OTHER; note = thymine
cagcatcgacatggtagacta

The invention claimed is:

1. An RNAi agent for inhibiting expression of a microtubule associated protein tau (MAPT) gene, comprising:
    an antisense strand consisting of the nucleotide sequence cPrpusAfsgucuAfccauGfuCfgAfugcussg (SEQ ID NO: 592), wherein a represents 2'-O-methyl adenosine, c represents 2'-O-methyl cytidine, g represents 2'-O-methyl guanosine, u represents 2'-O-methyl uridine; Af represents 2'-fluoro adenosine, Cf represents 2'-fluoro cytidine, Gf represents 2'-fluoro guanosine, Uf represents 2'-fluoro uridine; cPrpu represents 5'-cyclopropyl phosphonate-2'-O-methyl uridine; s represents a phosphorothioate linkage; and ss represents a phosphorodithioate linkage; and
    a sense strand comprising a nucleotide sequence that is at least partially complementary to the antisense strand; wherein all of the nucleotides of the sense strand are modified nucleotides.

2. The RNAi agent of claim 1, wherein all or substantially all of the nucleotides of the sense strand are modified with 2'-O-methyl nucleotides, 2'-fluoro nucleotides, or combinations thereof.

3. The RNAi agent of claim 1, wherein the sense strand is 18 to 30 nucleotides in length.

4. The RNAi agent of claim 1, wherein the sense strand is 21 nucleotides in length.

5. The RNAi agent of claim 1, wherein the sense strand comprises one or two terminal caps.

6. The RNAi agent of claim 1, wherein the sense strand comprises one or two inverted abasic residues.

7. The RNAi agent of claim 1, wherein the sense strand comprises a nucleotide sequence of one of the following nucleotide sequences (5'→3'):

GCAUCGACAUGGUAGACUA; (SEQ ID NO: 540)

or

CAGCAUCGACAUGGUAGACUA. (SEQ ID NO: 777)

8. The RNAi agent of claim 1, wherein the sense strand comprises the nucleotide sequence (5'→3'):
    cagcaucgAfcAfUfgguagacua (SEQ ID NO: 598);
    wherein a represents 2'-O-methyl adenosine, c represents 2'-O-methyl cytidine, g represents 2'-O-methyl guanosine, u represents 2'-O-methyl uridine; Af represents 2'-fluoro adenosine, Cf represents 2'-fluoro cytidine, Gf represents 2'-fluoro guanosine, and Uf represents 2'-fluoro uridine.

9. The RNAi agent of claim 1, wherein the RNAi agent is linked to an antigen binding protein.

10. The RNAi agent of claim 9, wherein the antigen binding protein is an antibody fragment (Fab), wherein the Fab specifically binds to one or more epitopes on a transferrin receptor (TfR1).

11. The RNAi agent of claim 10, wherein the Fab comprises (i) 6 complementary determining regions (CDRs), (ii) 3 CDRs on the variable light chain (VL), and (iii) 3 CDRs on the variable heavy chain (VH).

12. The RNAi agent of claim 11, wherein the variable light chain has a VL CDR1 sequence selected from the group consisting of: RASDGLYSNLA (SEQ ID NO: 6), RASDNLYRNLA (SEQ ID NO: 7), and RASDKLYSNLA (SEQ ID NO: 8); a VL CDR2 sequence selected from the group consisting of: DATLLAS (SEQ ID NO: 9), DARNLAS (SEQ ID NO: 10), DAFNLAS (SEQ ID NO: 11), DATRLAS (SEQ ID NO: 12), DATKLAS (SEQ ID NO: 13), and DAKNLAS (SEQ ID NO: 14); and/or a VL CDR 3 sequence of QHFWGTPLT (SEQ ID NO: 15).

13. The RNAi agent of claim 11, wherein the variable light chain is selected from any one of the VL chains shown in Table A.

14. The RNAi agent of claim 11, wherein the variable heavy chain has a VH CDR1 sequence selected from the group consisting of: GYTFNSYWMH (SEQ ID NO: 16), GYTFKSYWMH (SEQ ID NO: 17), GFTFTSYWMH (SEQ ID NO: 18), GYTFTSYWVH (SEQ ID NO: 19), and GYTFTSYWMH (SEQ ID NO: 20), a VH CDR2 sequence selected from the group consisting of: EINPTN-GRVNYIEKFKS (SEQ ID NO: 21), EINPTN-GRFNYIEKFKS (SEQ ID NO: 22), EINPTN-GRTNYIEKFKS (SEQ ID NO: 23), and EINPTNGRSNYIEKFKS (SEQ ID NO: 24); and/or a VH CDR3 sequence of: GTRAYHY (SEQ ID NO: 25).

15. The RNAi agent of claim 11, wherein the variable heavy chain is selected from any one of the VH chains shown in Table B.

16. The RNAi agent of claim 9, wherein the antigen binding protein is linked to the 5' end of the sense strand.

17. The RNAi agent of claim 1, wherein the RNAi agent comprises a sense strand selected from the group consisting of:

```
                                    (SEQ ID NO: 694)
LP310-(NH-C6)s(invAb)scagcaucgAfcAfUfgguagacuas
(invAb);

(SEQ ID NO: 696)
LP462-(NH-C6)s(invAb)scagcaucgAfcAfUfgguagacuas
(invAb);

(SEQ ID NO: 702)
Fab0070-[CP-1113]-L20-(NH-C6)s(invAb)
scagcaucgAfcAfUfgguagacuas(invAb);
and (SEQ ID NO: 703)
Fab0070-L-1026-(NH-C6)s(invAb)
scagcaucgAfcAfUfgguagacuas(invAb);
``` wherein a represents 2'-O-methyl adenosine, c represents 2'-O-methyl cytidine, g represents 2'-O-methyl guanosine, u represents 2'-O-methyl uridine; Af represents 2'-fluoro adenosine, Cf represents 2'-fluoro cytidine, Gf represents 2'-fluoro guanosine, and Uf represents 2'-fluoro uridine, s represents a phosphorothioate linkage, (invAb) represents an inverted abasic nucleotide, LP310 represents the structure:

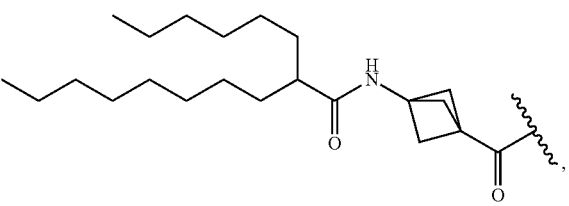 [SMILES: *C(=O)C12CC(NC(=O)C(CCCCCC)CCCCCCCC)(C1)C2]

LP462 represents the structure:

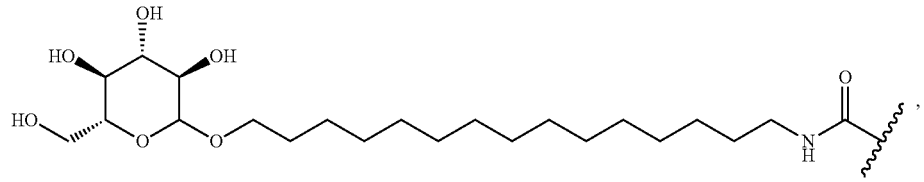 [SMILES: *C(=O)NCCCCCCCCCCCCCCCOC1O[C@H](CO)[C@@H](O)[C@H](O)[C@H]1O]

(NH-C6)s represents the structure:

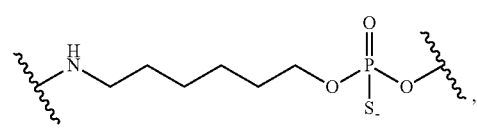

L20 represents the structure:

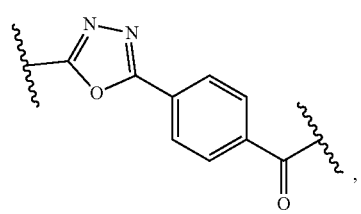 [SMILES: *C(=O)c1ccc(-c2nnc(*)o2)cc1]

[CP-1113] represents the structure

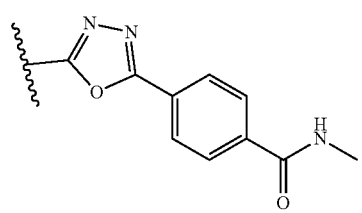 [SMILES: *c1nnc(-c2ccc(C(=O)NC)cc2)o1]

present on a cysteine residue of Fab0070, L-1026 represents the structure:

Linkage toward RNAi agent

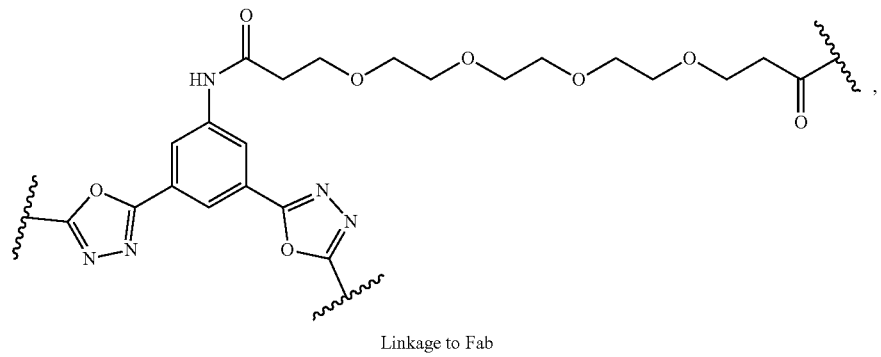 [SMILES: *C(=O)CCOCCOCCOCCOCCC(=O)Nc1cc(-c2nnc(*)o2)cc(-c2nnc(*)o2)c1]

Linkage to Fab and Fab0070 represents an antibody fragment having a heavy chain sequence of:

```
                                              (SEQ ID NO: 5)
EVQLVESGGGLVQPGGSLRLSCATSGFTFTSYWMHWVRQAPGKGLEWVA

EINPTNGRTNYIEKFKSRITLSVDKSKSTVYLQMNSLRAEDTAVYYCAR

GTRAYHYWGQGTLVTVSSASTKGPSVFPLAPSSKSTSGGTAALGCLVKD

YFPEPVTVSWNSGALTSGVHTFPAVLQSSGLYSLSSVVTVPSSSLGTQT

YICNVNHKPSNTKVDKRVEPKSCDKTH,
``` and an light chain sequence of:

```
                                              (SEQ ID NO: 3)
DIQLTQSPSSLSASVGDRVTITCRASDKLYSNLAWYQQKPGKAPKLLIY

DATLLASGVPSRFSGSGSGTDYTLTISSLQPEDFATYYCQHFWGTPLTF

GQGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEV

THQGLSSPVTKSFNRGEC.
```

18. A composition comprising the RNAi agent of claim 1, wherein the composition further comprises a pharmaceutically acceptable excipient.

19. The composition of claim 18, wherein the RNAi agent is a sodium salt.

20. The composition of claim 18, wherein the pharmaceutically acceptable excipient is water for injection.

21. A method for inhibiting expression of a MAPT gene in a cell, the method comprising introducing into a cell an effective amount of the RNAi agent of claim 1.

22. The method of claim 21, wherein the cell is within a human subject.

23. A method of treating one or more symptoms or diseases that are mediated at least in part by MAPT activity and/or MAPT gene expression, the method comprising administering to a human subject in need thereof a therapeutically effective amount of the RNAi agent of claim 1, wherein the method of treating provides relief from or alleviation of the number, severity, and/or frequency of the one or more symptoms or diseases in the human subject.

24. The method of claim 23, wherein the disease is a neurodegenerative disease.

25. The method of claim 24, wherein the neurodegenerative disease is selected from the group consisting of Alzheimer's disease, Frontotemporal lobar degeneration dementia (FTLD), Progressive supranuclear palsy, and other tauopathies.

26. The method of claim 25, wherein the disease is Alzheimer's disease.

* * * * *